US012139727B2

(12) United States Patent
Ambroso et al.

(10) Patent No.: US 12,139,727 B2
(45) **Date of Patent: *Nov. 12, 2024**

(54) ENGINEERED POLYMERASES

(71) Applicant: Element Biosciences, Inc., San Diego, CA (US)

(72) Inventors: Mark Ambroso, Escondido, CA (US); Tyler Lopez, Winchester, CA (US); Michael Klein, Encinitas, CA (US); Virginia Saade, San Diego, CA (US); Matthew Kellinger, San Diego, CA (US)

(73) Assignee: ELEMENT BIOSCIENCES, INC., San Diego, CA (US)

( * ) Notice: Subject to any disclaimer, the term of this patent is extended or adjusted under 35 U.S.C. 154(b) by 0 days.

This patent is subject to a terminal disclaimer.

(21) Appl. No.: 17/705,043

(22) Filed: Mar. 25, 2022

(65) Prior Publication Data

US 2022/0403353 A1 Dec. 22, 2022

Related U.S. Application Data

(60) Provisional application No. 63/212,540, filed on Jun. 18, 2021.

(51) Int. Cl.

| | |
|---|---|
| ***C12N 9/12*** | (2006.01) |
| ***C12P 19/34*** | (2006.01) |
| ***C12Q 1/6806*** | (2018.01) |
| ***C12Q 1/6834*** | (2018.01) |
| ***C12Q 1/6874*** | (2018.01) |

(52) U.S. Cl.

CPC ............ *C12N 9/1252* (2013.01); *C12P 19/34* (2013.01); *C12Q 1/6806* (2013.01); *C12Q 1/6834* (2013.01); *C12Q 1/6874* (2013.01); *C12Y 207/07007* (2013.01)

(58) Field of Classification Search

None

See application file for complete search history.

(56) References Cited

U.S. PATENT DOCUMENTS

| | | | | |
|---|---|---|---|---|
| 8,268,605 | B2 | 9/2012 | Sorge et al. | |
| 8,460,910 | B2 | 6/2013 | Smith et al. | |
| 8,852,910 | B2 | 10/2014 | Smith et al. | |
| 9,447,389 | B2 | 9/2016 | Smith et al. | |
| 10,017,750 | B2 | 7/2018 | Smith et al. | |
| 10,768,173 | B1 * | 9/2020 | Arslan ............... | G01N 33/5308 |
| 11,001,816 | B2 | 5/2021 | Klausing et al. | |
| 11,136,564 | B2 | 10/2021 | Smith et al. | |
| 11,220,707 | B1 * | 1/2022 | Arslan ................. | C12Q 1/6874 |
| 11,377,644 | B2 | 7/2022 | Kamtekar et al. | |
| 2009/0247414 | A1 | 10/2009 | Obradovic et al. | |
| 2011/0104761 | A1 | 5/2011 | Clark et al. | |
| 2013/0130320 | A1 | 5/2013 | Holliger et al. | |
| 2013/0165350 | A1 | 6/2013 | Kuimelis et al. | |
| 2013/0171631 | A1 | 7/2013 | Becker et al. | |
| 2014/0206550 | A1 | 7/2014 | Bjornson et al. | |
| 2020/0248258 | A1 | 8/2020 | Arslan et al. | |
| 2021/0079364 | A1 | 3/2021 | Naji et al. | |
| 2021/0318294 | A1 | 10/2021 | Previte et al. | |
| 2021/0348141 | A1 | 11/2021 | Klausing et al. | |
| 2022/0010290 | A1 | 1/2022 | Smith et al. | |
| 2022/0290216 | A1 | 9/2022 | Middleton et al. | |
| 2023/0087400 | A1 | 3/2023 | Kamtekar et al. | |

FOREIGN PATENT DOCUMENTS

| | | | |
|---|---|---|---|
| WO | WO 2005/024010 | A1 | 3/2005 |
| WO | WO 2009/131919 | A2 | 10/2009 |
| WO | WO 2015/166354 | A2 | 11/2015 |
| WO | WO 2018/148727 | A1 | 8/2018 |

OTHER PUBLICATIONS

Ngo, J. T. et al. "14: Computational Complexity, Protein Structure Prediction, and the Levinthal Paradox." The Protein Folding Problem and Tertiary Structure Prediction, Birkhauser, 1994, pp. 1-5.

Uniprot. "A0A497RSY7 • A0A497RSY7_9ARCH." Dna Polymerase, Candidatus Altiarchaeales archaeon, Aug. 2020, 2 pages, [Online] [Retrieved Oct. 4, 2022], Retrieved from the Internet <URL:https://www.uniprot.org/uniprotkb/A0A497RSY7/entry>.

United States Office Action, U.S. Appl. No. 17/705,020, filed Aug. 31, 2022, 17 pages.

PCT International Search Report and Written Opinion, PCT Application No. PCT/US2022/034021, Dec. 19, 2022, 26 pages.

PCT Invitation to Pay Additional Fees with Partial Search Report and Provisional Opinion, PCT Application No. PCT/US2022/034021, Oct. 28, 2022, 21 pages.

Ijaq, J. et al. "Annotation and Curation of Uncharacterzied Proteins-Challenges." Frontiers in Genetics, vol. 6, Mar. 31, 2015, pp. 1-7.

PCT International Search Report and Written Opinion, PCT Application No. PCT/US23/62874, Aug. 1, 2023, 20 pages.

PCT Invitation to Pay Additional Fees, PCT Application No. PCT/US23/62874, May 22, 2023, three pages.

Uniprot. "A0A3M1RGN5 • A0A3M1RGN5_UNCEA." Dna Polymerase, Euryarchaeota archaeon, Entry Version 7, Sep. 29, 2021, 2 pages, [Online] [Retrieved Jan. 31, 2024], Retrieved from the Internet <URL:https://www.uniprot.org/uniprotkb/A0A3M1RGN5/entry>.

United States Office Action, U.S. Appl. No. 17/705,020, filed Jul. 12, 2023, 19 pages.

(Continued)

*Primary Examiner* — Richard G Hutson

(74) *Attorney, Agent, or Firm* — Fenwick & West LLP

(57) ABSTRACT

Provided herein are engineered variants of archaeal, prokaryotic, and eukaryotic polymerases that exhibit enhanced thermostability, enhanced incorporation of 3' modified nucleotides, and improved uracil-tolerance, in polymerase-catalyzed nucleotide extension reactions relative to wild type polymerase enzymes. Also provided are uses of the engineered polymerases for forming complexed polymerases, forming binding complexes and forming ternary complexes, and uses for conducting nucleic acid sequencing reactions.

27 Claims, 48 Drawing Sheets

Specification includes a Sequence Listing.

(56) References Cited

OTHER PUBLICATIONS

United States Office Action, U.S. Appl. No. 18/160,952, filed Aug. 7, 2023, 12 pages.
United States Office Action, U.S. Appl. No. 18/160,951, filed Oct. 11, 2023, 10 pages.
Del Prado, A. et al. "New Insights into the Coordination Between the Polymerization and 3'-5' Exonuclease Activities in ϕ29 DNA Polymerase." Scientific Reports, vol. 9, Jan. 29, 2019, pp. 1-13.
PCT International Search Report and Written Opinion, PCT Application No. PCT/US2021/57441, Mar. 17, 2022, 17 pages.

* cited by examiner

Table 1:

| SEQ ID NO: | Mutation(s) relative to SEQ ID NO:1 | Incorp'n |
|---|---|---|
| 1 | Wild Type | 0 |
| 2 | L416F_Y417A_P418G_A493S_I529H_R515L_N567D_M142L | ++ |
| 3 | L416A_Y417S_P418S | + |
| 4 | Y502I | 0 |
| 5 | L416T_Y417G_P418A | 0 |
| 6 | L416S_Y417A_P418G_I529H_A493S_S443N | + |
| 7 | L416S_Y417A_P418G_I529H_A493S_Q492A_L496S | + |
| 8 | L416S_Y417A_P418G_I529H_A493S_L496N | + |
| 9 | Y417G_P418G_Y502V | + |
| 10 | L416F_Y417A_P418G_A493S_I529H_R515L_N567D_I63T | ++ |
| 11 | S415A | + |
| 12 | L416G_Y417T_P418S_I529H | + |
| 13 | S415A_P418G | 0 |
| 14 | L416F_Y417A_P418G_A493S_I529H_R515L_N567D_D305N_E328Q | + |
| 15 | L416F_Y417A_P418G_A493S_I529H_R515L_N567D_E434R | + |
| 16 | Y417A_P418G | + |
| 17 | L416F_Y417A_P418G_A493S_I529H_R515L_N567D_I343V | ++ |
| 18 | L416F_Y417A_P418G_A493S_I529H_R515L_N567D_M501I_N705D | ++ |
| 19 | L416G_Y417G | + |
| 20 | L416S_Y417A_P418G_I529H_A493S_R515L_S577I | + |
| 21 | L416V_Y417G_P418A | + |

FIG. 3-1

Table 1 (continued):

| SEQ ID NO: | Mutation(s) relative to SEQ ID NO:1 | Incorp'n |
|---|---|---|
| 22 | L416F_Y417A_P418G_A493S_I529H_R515L_N567D_M501V | ++ |
| 23 | A493V_K495A_N499A | 0 |
| 24 | L416A_P418S | + |
| 25 | L416F_Y417A_P418G_A493S_I529H_R515L_N567D_R509H_D560G | ++ |
| 26 | L416A_Y417G_P418S_I529H | + |
| 27 | L416S_Y417A_P418G_I529H_A493S | + |
| 28 | Y417G_P418G | 0 |
| 29 | L416S_Y417A_P418G_I529H_K473A_L496A | 0 |
| 30 | L416T_Y417G_P418A_I529H | + |
| 31 | L416S_Y417A_P418G_I529H_A493S_R515L_L611S | + |
| 32 | L416S_Y417A_P418G_I529H_Q492R | + |
| 33 | Y417A_P418A | 0 |
| 34 | L416F_Y417A_P418G_A493S_I529H_R515L_N567D_M41L | ++ |
| 35 | S415V_L416S | 0 |
| 36 | L416F_Y417A_P418G_A493S_I529H_R515L_N567D_G96S | ++ |
| 37 | L416A_Y417G_P418G_I529H | + |
| 38 | L416S_Y417A_P418G_I529H_A493S_R697G | + |
| 39 | L416A_Y417A_P418A | + |
| 40 | Y417V_P418G_Y502G | + |
| 41 | L416S_Y417A_P418G | + |
| 42 | L416F_Y417A_P418G_A493S_I529H_R515L_N567D_D636G | ++ |

FIG. 3-2

Table 1 (continued):

| SEQ ID NO: | Mutation(s) relative to SEQ ID NO:1 | Incorp'n |
|---|---|---|
| 43 | L416V_P418G | 0 |
| 44 | S415G_Y417S | 0 |
| 45 | L416G_Y417A | + |
| 46 | A493V_K495G_N499A | 0 |
| 47 | L416S_Y417A_P418G_I529H_A493S_R515L_N567D_C104S | + |
| 48 | L416I_Y417A_P418G_I529F | + |
| 49 | L416F_Y417A_P418G_A493S_I529H_R515L_N567D_I272V | + |
| 50 | L416V_Y417A_P418S | + |
| 51 | L416S_Y417A_P418G_I529H_Q492R_P335Q | + |
| 52 | L416F_Y417A_P418G_A493S_I529H_R515L_N567D_Y448H_F507S_Y502F_V564I_M565V_E578N | ++ |
| 53 | L416F_Y417A_P418G_A493S_I529H_R515L_N567D_R483H_K574R | ++ |
| 54 | L416S_Y417A_P418G_I529H_A493S_L496C | + |
| 55 | L416F_Y417A_P418G_A493S_I529H_R515L_N567D_M501I | ++ |
| 56 | S415G_P418A | 0 |
| 57 | S415G_Y417V | 0 |
| 58 | L416V_Y417A_P418S_I529H | + |
| 59 | Y417G_P418C | + |
| 60 | Y502A | 0 |
| 61 | L416F_Y417A_P418G_A493S_I529H_R515L_N567D_R467C_E581G_T618A | ++ |
| 62 | L416S_Y417A_P418G_I529H_A493S_Q492C_L496R | + |
| 63 | L416S_Y417A_P418G_I529H_A493S_L496H | + |

FIG. 3-3

Table 1 (continued):

| SEQ ID NO: | Mutation(s) relative to SEQ ID NO:1 | Incorp'n |
|---|---|---|
| 64 | L416S_Y417A_P418G_I529H_A493S_R515P | + |
| 65 | L416F_Y417A_P418A_A493S_I529H_R515L _N567D_E516G | ++ |
| 66 | L416A_Y417A_P418S_I529H | + |
| 67 | L416F_Y417A_P418G_A493S_I529H_R515L _N567D_S520G | ++ |
| 68 | L416F_Y417A_P418G_A493S_I529H_R515L _N567D_T344I | ++ |
| 69 | H405P_A493V_K495G_N499A | 0 |
| 70 | L416V_Y417G_P418G_I529H | + |
| 71 | L416S_Y417A_P418G_I529H_A493S_R515L _N567D_C514S | + |
| 72 | I529H | + |
| 73 | L416F_Y417A_P418G_A493S_I529H_R515L _N567D_M41L | ++ |
| 74 | Y417A_P418S | 0 |
| 75 | L416V_P418S | 0 |
| 76 | Y10F_E14K_H48R_D75N_C104V_A115V _C130V_L416F_Y417A_P418G_R515L_I529H _N567D_E680D_N705D_T522S | + |
| 77 | Y417S_P418V_Y502R | 0 |
| 78 | S415V_P418V | 0 |
| 79 | L416S_Y417A_P418G_I529H_R608K_A493S | + |
| 80 | L416F_Y417A_P418G_A493S_I529H_R515L _N567D_M501I_V789A | ++ |
| 81 | L416F_Y417A_P418G_A493S_I529H_R515L _N567D_I63V_E77G_Q87H | ++ |
| 82 | R414S | 0 |
| 83 | A493V_K495Q_N499G | 0 |
| 84 | A493V_K495V_N499A | 0 |

FIG. 3-4

Table 1 (continued):

| SEQ ID NO: | Mutation(s) relative to SEQ ID NO:1 | Incorp'n |
|---|---|---|
| 85 | L416F_Y417A_P418G_A493S_I529H_R515L_N567D | ++ |
| 86 | L416S_Y417A_P418G_A493S_I529H_K610E | + |
| 87 | A493V_K495S_N499V | 0 |
| 88 | L416F_Y417A_P418G_A493S_I529H_R515L_N567D_E14G_I68V | ++ |
| 89 | L416M_Y417A_P418G_A493S_I529H_R515L_N567D | + |
| 90 | S415G_L416V | 0 |
| 91 | L416S_Y417A_P418G_I529H_A493S_R515L_N567D_E179R | + |
| 92 | L416S_Y417A_P418G_I529H_A493S_Q492G | + |
| 93 | L416F_Y417A_P418G_A493S_I529H_R515L_N567D_I343V | ++ |
| 94 | Y417G_P418V | 0 |
| 95 | L416F_Y417A_P418G_A493S_I529H_R515L_N567D_N480I_T618A | ++ |
| 96 | Y417G_P418A | 0 |
| 97 | L416S_Y417A_P418G_I529H_R608K | + |
| 98 | S415V_Y417S | + |
| 99 | L416F_Y417A_P418G_A493S_I529H_R515L_N567D_P45S_K58R | ++ |
| 100 | L416S_Y417A_P418G_I529H_A493S_R515L_N567D_C269S | + |
| 101 | L416F_Y417A_P418G_A493S_I529H_R515L_N567D_A498G | ++ |
| 102 | L416F_Y417A_P418G_A493S_I529H_R515L_N567D_D573N | ++ |

FIG. 3-5

Table 1 (continued):

| SEQ ID NO: | Mutation(s) relative to SEQ ID NO:1 | Incorp'n |
|---|---|---|
| 103 | L416F_Y417A_P418G_A493S_I529H_R515L _N567D_M501I_N705D | ++ |
| 104 | I529G | 0 |
| 105 | L416S_Y417A_P418G_I529H_A493S_Q492T _L496S | + |
| 106 | Y417G_P418S | + |
| 107 | L416F_Y417A_P418G_A493S_I529H_R515L _N567D_E205K_K225E | ++ |
| 108 | S415G_L416S | 0 |
| 109 | L416F_Y417A_P418G_A493S_I529H_R515L _N567D_M501I_G763S | + |
| 110 | L416L_Y417Y_P418P_I529H | 0 |
| 111 | Y417S_P418A | + |
| 112 | Y502Q | 0 |
| 113 | L416S_Y417A_P418G_I529H_V489I_Q492R | 0 |
| 114 | C104V_C130V_C269V_L416F _Y417A_P418G_A493S_R515L_I529H_ N567D_ M768* | + |
| 115 | L416V_Y417V_P418A | + |
| 116 | Y417G_P418A_Y502N | + |
| 117 | E14K_H48R_D75N_C104V_A115V_C130V _D141A_E143A _C269V_F369I_N385S_L416S _Y417A_P418G_A493S_M501I_R515L_I529H _N567D_N705D | ++ |
| 118 | L416F_Y417A_P418G_A493S_I529H_R515L _N567D_S500G | ++ |
| 119 | L416S_Y417A_P418G_I529H_A493S_Q492R | 0 |
| 120 | A493V_K495S_N499G | 0 |
| 121 | L416S_Y417A_P418G_I529H_K473A | + |
| 122 | L416V_Y417T_P418I | 0 |

FIG. 3-6

Table 1 (continued):

| SEQ ID NO: | Mutation(s) relative to SEQ ID NO:1 | Incorp'n |
|---|---|---|
| 123 | L416S_Y417A_P418G_I529H_A493S_R515L _N567D_C450S | + |
| 124 | L416F_Y417A_P418G_A493S_I529H_R515L _N567D_A115V | + |
| 125 | S415V_P418S | 0 |
| 126 | L416F_Y417A_P418G_A493S_I529H_R515L _N567D_V239I_R256H | ++ |
| 127 | S415A_L416S | 0 |
| 128 | L416I_Y417A_P418A_I529L | + |
| 129 | Y10F_E14K_H48R_D75N_C104V_A115V _C130V_D141A_E143A_L416F_Y417A_P418G _R515L_I529H_N567D_E680D_N705D | ++ |
| 130 | L416A_Y417A_P418A_I529H | + |
| 131 | L416S_Y417A_P418G_I529H_K473A_Q492R | + |
| 132 | L416S_Y417A_P418G_I529H_A493S_G355S _S440N_R515L | + |
| 133 | L416V_Y417A_P418A | + |
| 134 | A493V_K495V_N499G | 0 |
| 135 | L416S_Y417A_P418G_I529H_A493S_L496R | + |
| 136 | L416S_Y417A_P418G_I529H_A493S_R515L _N567D_E730R | + |
| 137 | L416S_Y417A_P418G_I529H_A493S_E760G | + |
| 138 | L416V_Y417A_P418G_I529T | + |
| 139 | L416I_Y417A_P418A | + |
| 140 | L416S_Y417G_P418G_I529H | + |
| 141 | Y417V_P418A | 0 |
| 142 | S415A_Y417G | + |
| 143 | L416V_Y417T_P418S_I529H | + |
| 144 | S415G_P418G | 0 |

FIG. 3-7

Table 1 (continued):

| SEQ ID NO: | Mutation(s) relative to SEQ ID NO:1 | Incorp'n |
|---|---|---|
| 145 | L416F_Y417A_P418G_A493S_I529H_R515L_N567D_D9N | ++ |
| 146 | A493V_K495G_N499S | 0 |
| 147 | L416S_Y417A_P418G_I529H_A493S_L496I | + |
| 148 | S415V_Y417A | 0 |
| 149 | L416S_P418G | + |
| 150 | L416S | + |
| 151 | L416S_Y417A_P418G_I529H_A493S_L496Y | + |
| 152 | L416F_Y417A_P418G_A493S_I529H_R515L_N567D_E116G | ++ |
| 153 | S415G_L416A | 0 |
| 154 | L416V_Y417A_P418G_I529S | + |
| 155 | Y502S | 0 |
| 156 | Y417S_P418S | + |
| 157 | S415V_Y417A_A493V_K495G_N499S | 0 |

FIG. 3-8

Table 2:

| SEQ ID NO: | Mutation(s) relative to SEQ ID NO:1 | Incorp'n |
|---|---|---|
| 158 | L416A_P418A | + |
| 159 | A493V_K495S_N499G_F507S | 0 |
| 160 | L416S_Y417A_P418G_I529H_A493S_R515Y | + |
| 161 | L416S_Y417A_P418G_I529H_A493S_R515L_N567D_E308R | + |
| 162 | L416S_Y417A_P418G_I529H_A493S_L496S | + |
| 163 | L416F_Y417A_P418G_A493S_I529H_R515L_N567D_A568V | + |
| 164 | L416S_Y417A_P418G_I529H_A493S_R515L | + |
| 165 | R468G | 0 |
| 166 | L416F_Y417A_P418G_A493S_I529H_R515L_N567D_H48R | + |
| 167 | S415G | 0 |
| 168 | L416S_Y417A_P418G_I529H_A493S_Q492G_L496I | + |
| 169 | L416S_Y417T_P418G_I529H_A493S_R515L_N567D | + |
| 170 | Y417T_P418K | 0 |
| 171 | L416S_Y417A_P418G_I529H_D622T | + |
| 172 | L416S_Y417A_P418G_I529H_A493S_L496G | + |
| 173 | L416V_Y417G_P418G | + |
| 174 | L416F_Y417A_P418G_A493S_I529H_R515L_N567D_M84L | ++ |
| 175 | L416V_Y417G_P418A_I529H | + |
| 176 | Y417S_P418G_Y502S | 0 |
| 177 | L416T_Y417A_P418A | + |
| 178 | L416I_Y417S_P418S | + |

FIG. 4-1

Table 2 (continued):

| SEQ ID NO: | Mutation(s) relative to SEQ ID NO:1 | Incorp'n |
|---|---|---|
| 179 | L416F_Y417A_P418G_A493S_I529H_R515L _N567D_D191G | + |
| 180 | L416S_Y417A_P418G_I529H_A493S_R515L _N567D_E291R | + |
| 181 | L416S_Y417A_P418G_I529H_Q673I | + |
| 182 | L416F_Y417A_P418G_A493S_I529H_R515L _N567D_Q54L_P126S | ++ |
| 183 | L416F_Y417A_P418G_A493S_I529H_R515L _N567D_G474D | ++ |
| 184 | L416S_Y417A_P418G_I529H_A493S_L494V _L496N | + |
| 185 | I529S | 0 |
| 186 | L416F_Y417A_P418G_A493S_I529H_R515L _N567D_F539Y | ++ |
| 187 | A493V_K495G_N499V | 0 |
| 188 | L416S_Y417A_P418G_I529H_A493S_R515L _N567D_E434R | + |
| 189 | L416F_Y417A_P418G_A493S_I529H_R515L _N567D_K762R_G763V_L764W_G765A_K766S _Q767K_M768* | ++ |
| 190 | L416G_P418A | 0 |
| 191 | L416I_Y417A_P418S | + |
| 192 | L416S_Y417A_P418G_I529H_A493S_S443N _Q492F | + |
| 193 | L416A | + |
| 194 | L416S_Y417A_P418G_A493S_I529H_K58M | + |
| 195 | L416S_Y417A_P418G_I529H_L496A | + |
| 196 | L416S_Y417A_P418G_I529H_V489I | + |

FIG. 4-2

Table 2 (continued):

| SEQ ID NO: | Mutation(s) relative to SEQ ID NO:1 | Incorp'n |
|---|---|---|
| 197 | L416F_Y417A_P418G_A493S_I529H_R515L _N567D_M501I_N705D | ++ |
| 198 | L416A_Y417A_P418I | 0 |
| 199 | L416S_Y417A_P418G_I529H_A493S_D653G _A669D_S717G_I750V | + |
| 200 | L416V_Y417G_P418S_I529H | + |
| 201 | L416S_Y417A_P418G_I529H_A493S_R515F | + |
| 202 | L416F_Y417A_P418G_A493S_I529H_R515L _N567D_K51R | ++ |
| 203 | A493V_K495G_N499G_M501I | 0 |
| 204 | Y502P | 0 |
| 205 | L416S_Y417A_P418G_I529H_A493S_V651M | + |
| 206 | Y417V_P418S | 0 |
| 207 | L416Y_Y417A_P418G_A493S_I529H_R515L _N567D | ++ |
| 208 | Y10F_E14K_H48R_D75N_C104V_A115V _C130V_L416Y_Y417A_P418P_R515L_I529H _N567D_E680D_N705D_T522S | ++ |
| 209 | L416F_Y417A_P418G_A493S_I529H_R515L _N567D_M501I_M41L | + |
| 210 | L416F_Y417A_P418G_A493S_I529H_R515L _N567D_R509H_S520N_M583K | 0 |
| 211 | L416G_P418G | 0 |
| 212 | L416F_Y417A_P418G_A493S_I529H_R515L _N567D_M501I | ++ |
| 213 | L416S_Y417A_P418G_I529H_A493S_D381Y | + |
| 214 | L416F_Y417A_P418G_A493S_I529H_R515L _N567D_D75N | + |
| 215 | L416S_Y417A_P418G_I529H_V489I_A493S | + |
| 216 | Y417V_P418V_Y502S | 0 |

FIG. 4-3

Table 2 (continued):

| SEQ ID NO: | Mutation(s) relative to SEQ ID NO:1 | Incorp'n |
|---|---|---|
| 217 | R468H | 0 |
| 218 | L416F_Y417A_P418G_A493S_I529H_R515L_N567D_E116G | ++ |
| 219 | L416A_Y417A_P418V | 0 |
| 220 | L416S_Y417A_P418G_I529H_A493S_R515L_N567D_E27R | + |
| 221 | L416S_Y417A_P418G_I529H_A493S_L496A | + |
| 222 | L416S_Y417A_P418G_I529H_A493S_Q492L_L496M | 0 |
| 223 | A493V_K495S_N499G | 0 |
| 224 | L416S_Y417A_P418G_I529H_A493S_R515L_N567D_C130S | + |
| 225 | L416S_Y417A_P418G_I529H_A493S_R515L_N567D | + |
| 226 | Y417V_P418A_Y502R | 0 |
| 227 | L416S_Y417A_P418G_I529F | + |
| 228 | L416S_Y417A_P418G_I529H_R515L | + |
| 229 | R468V | 0 |
| 230 | L416S_Y417A_P418G_I529H_A493S_D622T | + |
| 231 | S415A_Y417A | + |
| 232 | A493V_K495V_N499S | 0 |
| 233 | L416I_Y417A_P418S_I529H | + |
| 234 | L416F_Y417A_P418G_A493S_I529H_R515L_N567D_E308R | ++ |
| 235 | L416F_Y417A_P418G_A493S_M501I_R515L_I529H_N567D_N657D_E700K_N705S | + |
| 236 | L416S_Y417A_P418G_I529H_A493S_R515L_N567D_C517S | + |

FIG. 4-4

Table 2 (continued):

| SEQ ID NO: | Mutation(s) relative to SEQ ID NO:1 | Incorp'n |
|---|---|---|
| 237 | H405P_A493V_K495V_N499A | 0 |
| 238 | L416I_Y417G_P418A_I529L | + |
| 239 | L416S_Y417A_P418G_I529H_A493S_R515L_N567D_E102R | + |
| 240 | L416S_Y417A_P418T_I529H | + |
| 241 | Y502G | 0 |
| 242 | L416V_Y417V_P418G | + |
| 243 | R468A | 0 |
| 244 | L416A_Y417A_P418G | + |
| 245 | S415G_P418S | 0 |
| 246 | L416S_Y417A_P418G_I529H_Q492R_Q673I | + |
| 247 | L416F_Y417A_P418G_A493S_I529H_R515L_N567D_I11F_K105R | ++ |
| 248 | L416F_Y417A_P418G_A493S_I529H_R515L_N567D_K61E | + |
| 249 | Y417A_P418S_Y502R | + |
| 250 | L416I_Y417A_P418G | + |
| 251 | Y10F_E14K_H48R_D75N_C104V_A115V_C130V_L416F_Y417A_P418P_R515L_I529H_N567D_E680D_N705D_T522S | ++ |
| 252 | L416F_Y417A_P418P_A493S_I529H_R515L_N567D_F507S | ++ |
| 253 | L416S_Y417A_P418G_I529H_A493S_R515L_N567D_E310R | + |
| 254 | L416F_Y417A_P418G_A493S_I529H_R515L_N567D_E14K | + |
| 255 | A493V_K495G_N499G | 0 |

FIG. 4-5

Table 3:

| SEQ ID NO: | Mutation(s) relative to SEQ ID NO:1 | Incorp'n |
|---|---|---|
| 288 | L416A_P418G | + |
| 289 | L416S_Y417A_P418G_A493S_I529H_E569G | + |
| 290 | L416S_Y417A_P418G_I529H_A493S_R515L_N567D_C130R | + |
| 291 | L416S_Y417A_P418G_I529H_A493S_R515L_S717G | + |
| 292 | L416S_Y417G | + |
| 293 | L416F_Y417A_P418G_A493S_I529H_R515L_N567D_K58M | ++ |
| 294 | L416F_Y417A_P418A_A493S_I529H_R515L_N567D_S500G | ++ |
| 295 | A493V_K495Q_N499G_F507S | 0 |
| 296 | G403A_H405S_D406H | 0 |
| 297 | L416S_Y417A_P418G_I529H | + |
| 298 | L416F_Y417A_P418G_A493S_I529H_R515L_N567D_M501I_S717N_S746C | + |
| 299 | A493V_K495A_N499G | 0 |
| 300 | Y502H | 0 |
| 301 | L416F_Y417A_P418G_A493S_I529H_R515L_N567D_N132S | ++ |
| 302 | L416A_Y417S_P418A | + |
| 303 | L416I_Y417I_P418V | 0 |
| 304 | S415V_L416V | 0 |
| 305 | Y417S_P418G | + |
| 306 | L416F_Y417A_P418G_A493S_I529H_R515L_N567D_A568V | + |
| 307 | L416V | + |
| 308 | L416S_P418V | 0 |
| 309 | S415V_P418G | 0 |

FIG. 5-1

Table 3 (continued):

| SEQ ID NO: | Mutation(s) relative to SEQ ID NO:1 | Incorp'n |
|---|---|---|
| 310 | H48R_D75N_A115V_L416F_Y417A_P418G_A493S_M501I_R515L_I529H_N567D_N705D | + |
| 311 | L416F_Y417A_P418G_A493S_I529H_R515L_N567D_M501I_E434R | ++ |
| 312 | Y502F | 0 |
| 313 | L416F_Y417A_P418G_A493S_I529H_R515L_N567D_D488N_G474S | ++ |
| 314 | L416A_Y417G_P418A | + |
| 315 | L416S_Y417A_P418G_I529H_A493S_R723H | + |
| 316 | S415G_P418V | 0 |
| 317 | A493V_K495S_N499S | 0 |
| 318 | Y502V | 0 |
| 319 | E14K_H48R_D75N_C104V_K105R_A115V_D129N_C130V_D141A_E143A_C269V_F369I_N385S_L416F_Y417A_P418G_A493S_M501I_R515L_I529H_N567D_N705D | + |
| 320 | L416S_Y417A_P418G_I529H_R608K_Q492R | 0 |
| 321 | L416S_Y417A_P418G_I529H_R515L_Q492R | + |
| 322 | L416S_Y417A_P418G_I529H_A493S_R515L_N567D_E758R | + |
| 323 | L416F_Y417A_P418G_A493S_I529H_R515L_N567D_Q767* | + |
| 324 | L416S_Y417A_P418G_I529H_R515L_Q673I | + |
| 325 | R468K | 0 |
| 326 | L416S_Y417A_P418G_I529H_L496A_V489I | + |
| 327 | L416S_Y417A_P418G_I529H_L496A_A493S_Q492R | + |

FIG. 5-2

Table 3 (continued):

| SEQ ID NO: | Mutation(s) relative to SEQ ID NO:1 | Incorp'n |
|---|---|---|
| 328 | L416S_Y417A_P418G_I529H_V489I_R515L | + |
| 329 | L416A_Y417A_P418S | + |
| 330 | L416F_Y417A_P418G_A493S_I529H_R515L_N567D_V465M | ++ |
| 331 | L416S_Y417G_P418A | + |
| 332 | A493V_K495Q_N499A | 0 |
| 333 | E14K_H48R_D75N_C104V_A115V_D129N_C130V_D141A_E143A_C269V_F369I_N385S_L416F_Y417A_P418G_A493S_M501I_R515L_I529H_N567D_N705D | + |
| 334 | S415V | 0 |
| 335 | L416F_Y417A_P418G_I529H_A493S_R515L_N567D_E434R | + |
| 336 | L416S_Y417A_P418G_I529H_A493S_R515W | + |
| 337 | L416S_Y417G_P418V_I529H | + |
| 338 | L416S_Y417G_P418V | 0 |
| 339 | S415G_L416G | 0 |
| 340 | L416F_Y417A_P418G_A493S_I529H_R515L_N567D_L50P | ++ |
| 341 | Y417G_P418A_Y502G | 0 |
| 342 | L416F_Y417A_P418G_A493S_I529H_R515L_N567D_M501I_T675A_K682I_N705D | + |
| 343 | L416F_Y417A_P418G_A493S_I529H_R515L_N567D_E73K | ++ |
| 344 | L416S_Y417G_P418G | 0 |
| 345 | L416I_Y417S_P418G_I529H | + |
| 346 | L416A_Y417G_P418A_I529H | + |
| 347 | L416F_Y417A_P418G_A493S_I529H_R515L_N567D_V107I | ++ |

FIG. 5-3

Table 3 (continued):

| SEQ ID NO: | Mutation(s) relative to SEQ ID NO:1 | Incorp'n |
|---|---|---|
| 348 | L416A_Y417A_P418A_I529L | + |
| 349 | L416S_Y417A_P418G_I529H_A493S_E370D | + |
| 350 | L416S_Y417A_P418G_I529H_R608K_L496A | 0 |
| 351 | L416F_Y417A_P418G_A493S_I529H_R515L_N567D_R170H | ++ |
| 352 | L416S_Y417A_P418G_I529H_A493S_S717G | + |
| 353 | L416V_Y417A_P418A_I529H | + |
| 354 | L416A_Y417A_P418G_I529H_A493S_R515L_N567D | + |
| 355 | Y10F_E14K_H48R_D75N_C104V_A115V_C130V_L416F_Y417G_P418P_R515L_I529H_N567D_E680D_N705D_T522S | ++ |
| 356 | R468S | 0 |
| 357 | L416F_Y417A_P418G_A493S_I529H_R515L_N567D_K538R | ++ |
| 358 | A493V_K495S_N499A_Y502T | 0 |
| 359 | A493V_K495Q_N499V | 0 |
| 360 | L416T_Y417A_P418G_I529H | + |
| 361 | L416A_Y417S | + |
| 362 | L416V_Y417A_P418G_I529H | + |
| 363 | L416S_Y417A_P418G_I529H_A493S_L496S_D439S | + |
| 364 | L416F_Y417A_P418G_A493S_I529H_R515L_N567D_E14K_H48R_D75N_A115V_M501I | + |
| 365 | L416V_Y417A_P418G | + |
| 366 | D141A_E143A_L416F_Y417A_P418G_A493S_R515L_I529H_N567D | + |
| 367 | I529A | 0 |
| 368 | L416I_Y417S_P418G | + |
| 369 | L416F_Y417A_P418G_A493S_I529H_R515L_N567D_A115V | + |

FIG. 5-4

Table 3 (continued):

| SEQ ID NO: | Mutation(s) relative to SEQ ID NO:1 | Incorp'n |
|---|---|---|
| 370 | L416A_Y417S_P418G | + |
| 371 | L416S_Y417A_P418G_I529H_A493S_Q492G_L496A | + |
| 372 | L416I_Y417G_P418A | + |
| 373 | L416A_Y417I_P418T | 0 |
| 374 | L416S_Y417A | + |
| 375 | L416T_Y417A_P418A_I529H | + |
| 385 | Y417V_P418V | 0 |
| 386 | L416S_Y417A_P418G_I529H_K473A_R515L | 0 |
| 387 | Y417A_P418V | 0 |
| 388 | L416G_Y417G_P418G | 0 |
| 389 | I529V | 0 |
| 390 | L416S_Y417A_P418G_I529H_L496A_A493S_V489I | + |
| 394 | L416F_Y417A_P418G_A493S_I529H_R515L_N567D_E14K_H48R_D75N_A115V_M501I_N705D | ++ |
| 395 | L416S_Y417A_P418G_I529H_L496A_R515L | 0 |
| 396 | L416F_Y417A_P418G_A493S_I529H_R515L_N567D_L124Q_F37S_E14G | ++ |
| 397 | L416F_Y417A_P418G_A493S_I529H_R515L_N567D_D560E | ++ |

FIG. 5-5

Table 4:

| Candidatus Altiarchaeales archaeon DNA Polymerase | 9°N Polymerase | Vent DNA Polymerase | Deep Vent DNA Polymerase | Geobacillus stearothermophilus DNA Polymerase I | Pfu Polymerase | Pyrococcus abyssi Polymerase |
|---|---|---|---|---|---|---|
| Y10 | Y7 | Y7 | Y7 | G10 | Y7 | Y7 |
| E14 | N11 | D11 | D11 | R16 | E11 | D11 |
| H48 | D45 | S46 | D49 | E49 | S46 | D49 |
| K58 | T55 | K61 | K61 | D59 | K61 | K61 |
| D75 | Q72 | G77 ins R78 | G77 ins R78 | G76 ins R77 | G77 ins K78 | G77 ins R78 |
| V91 | V93 | V93 | V93 | --- | V93 | V93 |
| C104 | V106 | V106 | V106 | A97 | V106 | V106 |
| A115 | A117 | A117 | A117 | Y108 | A117 | A117 |
| C130 | D132 | D132 | D132 | Q123 | E150 | N132 |
| C269 | I264 | V266 | I264 | S240 | I264 | I264 |
| R296 | Y291 | G293 | Y291 | G277 | Y291 | Y291 |
| D305 | E300 | E302 | E300 | A286 | E300 | E300 |
| E328 | E321 | E323 | E321 | L318 | E321 | E321 |
| P335 | P328 | P330 | P328 | E325 | P328 | P328 |
| G355 | S348 | S350 | S348 | G342 | S348 | S348 |
| R359 | L352 | L354 | L352 | R343 | L352 | L352 |
| E370 | K363 | A365 | E363 | E349 | E363 | E363 |
| D381 | E374 | E376 | E374 | A359 | E374 | E374 |
| G403 | G395 | G398 | G396 | G384 | G396 | G396 |
| H405 | W397 | W400 | W398 | E386 | W398 | W398 |
| D406 | D398 | E401 | E399 | L387 | E399 | E399 |
| R414 | R406 | R409 | R407 | L394 | R407 | R407 |
| S415 | S407 | S410 | S408 | L395 | S408 | S408 |
| L416 | L408 | L411 | L409 | L396 | L409 | L409 |
| Y417 | Y409 | Y412 | Y410 | A397 | Y410 | Y410 |
| P418 | P410 | P413 | P411 | A398 | P411 | P411 |
| D439 | Y431 | Y434 | Y432 | E420 | Y432 | Y432 |
| S440 | D432 | D435 | D433 | A421 | D433 | D433 |
| S443 | P435 | P438 | P436 | S424 | P436 | P436 |
| C450 | C442 | C445 | C443 | K431 | C443 | C443 |

FIG. 6-1

Table 4 (continued):

| Candidatus Altiarchaeales archaeon DNA Polymerase | 9°N Polymerase | Vent DNA Polymerase | Deep Vent DNA Polymerase | Geobacillus stearothermophilus DNA Polymerase I | Pfu Polymerase | Pyrococcus abyssi Polymerase |
|---|---|---|---|---|---|---|
| R468 | R460 | R463 | R461 | K450 | R461 | R461 |
| K473 | R465 | K468 | R466 | W455 | T466 | K466 |
| V489 | Y481 | Y484 | Y482 | K476 | Y482 | Y482 |
| Q492 | R484 | R487 | R485 | Q479 | K485 | R485 |
| A493 | A485 | A488 | A486 | P480 | A486 | A486 |
| L494 | I486 | I489 | I487 | L481 | I487 | I487 |
| K495 | K487 | K490 | K488 | A482 | K488 | K488 |
| L496 | I488 | L491 | I489 | A483 | L489 | I489 |
| N499 | N491 | N494 | N492 | A486 | N492 | N492 |
| M501 | F493 | I496 | I494 | M488 | F494 | Y494 |
| Y502 | Y494 | Y1035 | Y1032 | E489 | Y495 | Y495 |
| F507 | Y499 | Y1040 | Y1037 | V493 | Y500 | Y500 |
| C514 | C506 | S1047 | C1044 | G504 | C507 | C507 |
| R515 | K507 | K1048 | K1045 | S505 | K508 | K508 |
| C517 | C509 | C1050 | C1047 | L507 | C510 | C510 |
| I529 | I521 | I1062 | I1059 | N527 | I522 | I522 |
| N567 | K559 | K1490 | K1097 | N573 | K560 | K559 |
| A568 | A560 | A1491 | A1098 | I574 | A561 | A560 |
| E569 | K561 | K1492 | L1099 | L575 | L562 | L561 |
| S577 | P569 | S1500 | A1107 | S585 | S570 | S569 |
| R608 | E600 | E1531 | E1138 | E632 | E601 | E600 |
| K610 | K602 | R1533 | K1140 | R634 | K603 | K602 |
| L611 | I603 | I1534 | I1141 | K635 | V604 | I603 |
| D622 | D614 | D1545 | D1152 | D647 | D615 | D614 |
| V651 | V643 | V1574 | V1181 | I689 | V644 | V643 |
| D653 | E645 | D1576 | E1183 | H691 | E646 | E645 |
| A669 | V661 | V1592 | V1199 | A707 | A662 | V661 |
| Q673 | Q665 | Q1596 | Q1203 | G711 | Q666 | Q665 |

FIG. 6-2

Table 4 (continued):

| Candidatus Altiarchaeales archaeon DNA Polymerase | 9°N Polymerase | Vent DNA Polymerase | Deep Vent DNA Polymerase | Geobacillus stearothermophilus DNA Polymerase I | Pfu Polymerase | Pyrococcus abyssi Polymerase |
|---|---|---|---|---|---|---|
| E680 | D672 | D1604 | E1210 | D718 | E673 | E672 |
| R697 | R689 | R1620 | R1227 | P744 | K690 | K689 |
| S717 | R709 | K1640 | P1247 | Y772 | P710 | P709 |
| R723 | I715 | I1646 | I1253 | S799 | I716 | I715 |
| I750 | I744 | I1675 | I1282 | V828 | I745 | I744 |
| E760 | D754 | D1685 | D1292 | E840 | D755 | D754 |
| N705 | T697 | T1628 | M1235 | N752 | M698 | M697 |
| K762 | R756 | R1687 | R1294 | E842 | R757 | K756 |
| G763 | G764 | Q1689 | G1302 | R843 | G765 | Q758 |
| L764 | L765 | S1690 | L1303 | L844 | L766 | K759 |
| G765 | G766 | S1691 | T1304 | C845 | T767 | T760 |
| K766 | A767 | K1692 | A1305 | E846 | S768 | K761 |
| Q767 | W768 | Q1693 | W1306 | P861 | W769 | Q762 |
| M768 | L4769 | T1694 | L1307 | L862 | L770 | V763 |

FIG. 6-3

```
Candid_WT       MKKTLLDADYITREEKAVVRLFYKTEEGREIQEVADFRPYMYVLPEEHDLKKLQREIKE
90N             ----MILDTDYITENGKPVIRVFKKENGEFKIEYDRTFEPYFYALLKDDSAIEDVKKVTA
                    :**:**** : *.*:*:* * :   :*:    * **:*.* :: .  :  .::.

Candid_WT       LKNITNVEIKRMIEGD-----REVEVLKVMVNQPRDVPNLRGLIKELEGCKEVREAHIPF
90N             KRHGTVVKVKRAEKVQKKFLGRPIEVWKLYFNHPQDVPAIRDRIRAHPAVVDIYEYDIPF
                 .: * *::**  : :     * :** *: .*:*.*** :*. *.   .  :: *  ***

Candid_WT       AERYLIDSGLIPMQDCENFDLRIAAFDMEVYNPRGEPKAERDPIIIISYADNRGLRRVWT
90N             AKRYLIDKGLIPMEGDE--ELTMLAFDIETLYHEGE-EFGTGPILMISYADGSE-ARVIT
                *:*****.*****:. *  :* : ***:*.    ** :   .**::*****.    ** *

Candid_WT       YKTVENLNLDYMEVLKDEREIIRRFIDTIREREIDIIVTYNGDNFDFPYLKERAEKHRIP
90N             WKKID---LPYVDVVSTEKEMIKRFLRVVREKDPDVLITYNGDNFDFAYLKKRCEELGIK
                :*.::   * *::*:. *.*:*.**: .:**.: *:::*********.***:*.*:  *

Candid_WT       VSLGVDGSPLRLERRGMNLGARVTGRPHIDMYPVCRQIFNLSRYTLEDVYLEITGREKKD
90N             FTLGRDGSEPKIQRMGDRFAVEVKGRIHFDLYPVIRRTINLPTYTLEAVYEAVFGKPKEK
                .:** ***  .::* * .:.. *.** *:*:*** *. :**. **** **  : *. *:.

Candid_WT       IRVGEMAGIWDNPEKEKFKELIEYAMSDAESTLEIAITLLPLHYEISRITRELIYQSSRA
90N             VYAEEIAQAWES---GEGLERVARYSMEDAKVTYELGREFFPMEAQLSRLIGQSLWDVSRS
                : . *:*  *:.   *  :: :  *:*.**: * *:.  ::*:  ::**:  : ::: **:

Candid_WT       GSGQRVESLLIKKAFEKSILVPNRPSDRVVNERQRKTYIGAYVVEPKRGIHDNILLFDFR
90N             STGNLVEWFLLRKAYKRNELAPNKPDEREL-ARRRGGYAGGYVKEPERGLWDNIVYLDFR
                .:*: ** :*:.**::.. *.**.*.:* :  *.*  * *.** **:**:.***: :***

Candid_WT       SLYPSIIISHNIDPSTIDCECCPEDSYRSPTGHYFCKKKRGLIPETLNELVQRRIEVKKG
90N             SLYPSIIITHNVSPDTLNREGCKEYDVAPEVGHKFCKDFPGFIPSLLGDLLEERQKIKRK
                ********:**:.*.*:: * * * .  . .** ***.  *:**. *.:*:: * ::*.

Candid_WT       LKNEKNPERRRFLDVKQQALKLLANSMYGYFGFPRARWYCRECAESITALGRKYILHTI-
90N             MKATVDPLEKKLLDYRQRAIKILANSFYGYYGYAKARWYCKECAESVTAWGREYIEMVIR
                :*   :*  ..:** .*.*:*:****:***:*:..*****.*****:** **:**  .*

Candid_WT       DIVPKFGFDVIYGDTDSVYLIKPNITDRERVMKNAEHFLDKINSELPEAMELEFEGFYPR
90N             ELEEKFGFKVLYADTDGLHATIPG-ADAETVKKKAKEFLKYINPKLPGLLELEYEGFYVR
                ::  ****.*:*.***.::   *. :* * * *:*: **. **.:**  :***:**** *

Candid_WT       GIFITKKRYALIDERGKLIVKGLETKRRDWANIAKDTQEKVLDALLKDKNPEKAASIVKD
90N             GFFVTKKKYAVIDEEGKITTRGLEIVRRDWSEIAKETQARVLEAILKHGDVEEAVRIVKE
                *:*:***.**:*** **: ..***  ****::***:** .**:*:**  : *:*. ***:
```

FIG. 7-1

```
Candid_WT          VIRNIKTGKIPLKDLAINTQITRGMAEYKTEGPHIVAAKKAMKRGLEFKQGNIVTYVVTK
90N                VTEKLSKYEVPPEKLVIHEQITRDLRDYKATGPHVAVAKRLAARGVKIRPGTVISYIVLK
                   *  ::.. ::* :.*.*: ****.: ;**: ***:..**.   **:::. *.:::*:* *

Candid_WT          KGKSISDKARVIDFVEEGD--YDPDYYINNQVLPSVLRILEALGYSEDELK-------GL
90N                GSGRIGDRAIPADEFDPTKHRYDAEYYIENQVLPAVERILKAFGYRKEDLRYQKTKQVGL
                    .  *.*.*   * .:  .  **.:***:*****:* ***:*:** :::*.       **

Candid_WT          GKQMKLGGF-
90N                GAWLKVKGKK
                   *  .:*: *
```

FIG. 7-2

```
Candid_WT      MKKTLLDADYITREEKAVVRLFYKTEEGREIQEVADFRPYMY-VLPEEHDLKKL-----
Vent           ----MILDTDYITKDGKPIIRIFKKENGEFKIELDPHFQPYIYALLKDDSAIEEIKAIKG
                   :**:****.: *.::*:* * :   :*:  . *.**:* :* ::  ::::

Candid_WT      QREIKELKNITNVEIKRMIEGDREVEVLKVMVNQPRDVPNLRGLIKELEGCKEVREAHIP
Vent           ERHGKTVRVLDAVKVRKKFLG-REVEVWKLIFEHPQDVPAMRGKIREHPAVVDIYEYDIP
               :*  * :. :  *::.. : * ***** *::.::*.*** :** *.*   . :: *  **

Candid_WT      FAERYLIDSGLIPMQDCENFDLRIAAFDMEVYNPRGEPKAERDPIIIISYADNRGLRRVW
Vent           FAKRYLIDKGLIPMEGDE--ELKLLAFDIETFYHEGD-EFGKGEIIMISYADEEE-ARVI
               **:*****.*****:. *  :*.: ***:*.:   *: :   ..**:*****:    **

Candid_WT      TYKTVENLNLDYMEVLKDEREIIRRFIDTIREREIDIIVTYNGDNFDFPYLKERAEKHRI
Vent           TWK---NIDLPYVDVVSNEREMIKRFVQVVKEKDPDVIITYNGDNFDLPYLIKRAEKLGV
               *:*   *::* *::*:.:***:*.**::.:.*.: *:*:********:*** :****  :

Candid_WT      PVSLGVDG--SPLRLERRGMNLGARVTGRPHIDMYPVCRQIFNLSRYTLEDVYLEITGRE
Vent           RLVLGRDKEHPEPKIQRMGDSFAVEIKGRIHFDLFPVVRRTINLPTYTLEAVYEAVLGKT
                : ** *   .  .::* * .:.. :.** *:*::** *. :**. **** **  : *.

Candid_WT      KKDIRVGEMAGIWDNPEKEKFKELIEYAMSDAESTLEIAITLLPLHYEISRITRELIYQS
Vent           KSKLGAEEIAAIWET--EESMKKLAQYSMEDARATYELGKEFFPMEAELAKLIGQSVWDV
               *..: . *:*.**:.  :*.:*:* :*:*.** :* *:.  ::*:  *::.:  : :::

Candid_WT      SRAGSGQRVESLLIKKAFEKSILVPNRPSDRVVNERQRKTYIGAYVVEPKRGIHDNILLF
Vent           SRSSTGNLVEWYLLRVAYARNELAPNKPDEEEYKRRLRTTYLGGYVKEPEKGLWENIIYL
               **:.:*: **  *:. *: .. *.**.*.:   : * *.**:*.** **:.*:.:**: :

Candid_WT      DFRSLYPSIIISHNIDPSTIDCECCPEDSYRSPTGHYFCKKKRGLIPETLNELVQRRIEV
Vent           DFRSLYPSIIVTHNVSPDTLEKEGCKNYDVAPIVGYRFCKDFPGFIPSILGDLIAMRQDI
               **********::**:.*.*:: * * : .  . .*: ***.  *:**. *.:*:  * ::

Candid_WT      KKGLKNEKNPERRRFLDVKQQALKLLANSM------------------------------
Vent           KKKMKSTIDPIEKKMLDYRQRAIKLLANSILPNEWLPIIENGEIKFVKIGEFINSYMEKQ
               ** :*.  :*  ..:** .*.*:******:

Candid_WT      ------------------------------------------------------------
Vent           KENVKTVENTEVLEVNNLFAFSFNKKIKESEVKKVKALIRHKYKGKAYEIQLSSGRKINI

Candid_WT      ------------------------------------------------------------
Vent           TAGHSLFTVRNGEIKEVSGDGIKEGDLIVAPKKIKLNEKGVSINIPELISDLSEEETADI

Candid_WT      ------------------------------------------------------------
Vent           VMTISAKGRKNFFKGMLRTLRWMFGEENRRIRTFNRYLFHLEKLGLIKLLPRGYEVTDWE
```

FIG. 8-1

```
Candid_WT       ------------------------------------------------------------
Vent            RLKKYKQLYEKLAGSVKYNGNKREYLVMFNEIKDFISYFPQKELEEWKIGTLNGFRTNCI

Candid_WT       ------------------------------------------------------------
Vent            LKVDEDFGKLLGYYVSEGYAGAQKNKTGGISYSVKLYNEDPNVLESMKNVAEKFFGKVRV

Candid_WT       ------------------------------------------------------------
Vent            DRNCVSISKKMAYLVMKCLCGALAENKRIPSVILTSPEPVRWSFLEAYFTGDGDIHPSKR

Candid_WT       ------------------------------------------------------------
Vent            FRLSTKSELLANQLVFLLNSLGISSVKIGFDSGVYRVYINEDLQFPQTSREKNTYYSNLI

Candid_WT       ------------------------------------------------------------
Vent            PKEILRDVFGKEFQKNMTFKKFKELVDSGKLNREKAKLLEFFINGDIVLDRVKSVKEKDY

Candid_WT       ----------------------------YGYFGFPRARWYCRECAESITALGRKYILHTI
Vent            EGYVYDLSVEDNENFLVGFGLLYAHNSYYGYMGYPKARWYSKECAESVTAWGRHYIEMTI
                                            ***:*:*.****..*****:** **:**  **

Candid_WT       -DIVPKFGFDVIYGD---------------------------------------------
Vent            REIEEKFGFKVLYADSVSGESEIIIRQNGKIRFVKIKDLFSKVDYSIGEKEYCILEGVEA
                 :*  ****.*:*.*

Candid_WT       -------------------------------TDSVY------------------------
Vent            LTLDDDGKLVWKPVPYVMRHRANKRMFRIWLTNSWYIDVTEDHSLIGYLNTSKTKTAKKI
                                               *:* *

Candid_WT       ------------------LIKPN-------------------------------------
Vent            GERLKEVKPFELGKAVKSLICPNAPLKDENTKTSEIAVKFWELVGLIVGDGNWGGDSRWA
                                  ** **

Candid_WT       ------------------------------------------------------------
Vent            EYYLGLSTGKDAEEIKQKLLEPLKTYGVISNYYPKNEKGDFNILAKSLVKFMKRHFKDEK

Candid_WT       ------------------------------------------------------------
Vent            GRRKIPEFMYELPVTYIEAFLRGLFSADGTVTIRKGVPEIRLTNIDADFLREVRKLLWIV

Candid_WT       -----------------------------------------ITDRER-------------
Vent            GISNSIFAETTPNRYNGVSTGTYSKHLRIKNKWRFAERIGFLIERKQKRLLEHLKSARVK
                                                         : :*:.

Candid_WT       ------------------------------------------------------------
Vent            RNTIDFGFDLVHVKKVEEIPYEGYVYDIEVEETHRFFANNILVHNTDGFYATIPGEKPEL
```

FIG. 8-2

```
Candid_WT     VMKNAEHFLDKINSELPEAMELEFEGFYPRGIFITKKRYALIDERGKLIVKGLETKRRDW
Vent          IKKKAKEFLNYINSKLPGLLELEYEGFYLRGFFVTKKRYAVIDEEGRITTRGLEVVRRDW
              : *:*: **: ***:**  :***:**** **:*:******:*** *.: ..***. ****

Candid_WT     ANIAKDTQEKVLDALLKDKNPEKAASIVKDVIRNIKTGKIPLKDLAINTQITRGMAEYKT
Vent          SEIAKETQAKVLEAILKEGSVEKAVEVVRDVVEKIAKYRVPLEKLVIHEQITRDLKDYKA
              ::***:** ***:*:**: . ***..:*.**: :* . .:**:.*.*: ****.: :**:

Candid_WT     EGPHIVAAKKAMKRGLEFKQGNIVTYVVTKKGKSISDKARVIDFVE--EGDYDPDYYINN
Vent          IGPHVAIAKRLAARGIKVKPGTIISYIVLKGSGKISDRVILLTEYDPRKHKYDPDYYIEN
               ***:. **.   **::.* *.*::*:* * . .***.. ::   :  : .*******:*

Candid_WT     QVLPSVLRILEALGYSEDELK-GLGKQMKLGGF---
Vent          QVLPAVLRILEAFGYRKEDLRYQSSKQTGLDAWLKR
              ****:*******:** :::*.   .**  *..:
```

FIG. 8-3

```
Candid_WT    MKKTLLDADYITREEKAVVRLFYKTEEGREIQEVADFRPYMYVLPEE-----HDLKKL--
Deep         ---MILDADYITEDGKPIIRIFKKENGEFKVEYDRNFRPYIYALLKDDSQIDEVRKITA
                 :******* : *.::*:* * :    :::   :****:*.* ::      ::.*:

Candid_WT    QREIKELKNITNVEIKRMIEGDREVEVLKVMVNQPRDVPNLRGLIKELEGCKEVREAHIP
Deep         ERHGKIVRIIDAEKVRKKFLG-RPIEVWRLYFEHPQDVPAIRDKIREHSAVIDIFEYDIP
             :*   * :. *    ::.. : * * :** .: .::*.*** :*. *.* ..   :: *  **

Candid_WT    FAERYLIDSGLIPMQDCENFDLRIAAFDMEVYNPRGEPKAERDPIIIISYADNRGLRRVW
Deep         FAKRYLIDKGLIPMEGDE---ELKLLAFDIETLYHEGEEFA-KGPIIMISYADEEE-AKVI
             **:*****.*****:. *   :*.: ***:*.     **  * ..***:*****:     .*

Candid_WT    TYKTVENLNLDYMEVLKDEREIIRRFIDTIREREIDIIVTYNGDNFDFPYLKERAEKHRI
Deep         TWKKID---LPYVEVVSSEREMIKRFLKVIREKDPDVIITYNGDSFDLPYLVKRAEKLGI
             *:*.::    * *:**:..***:*.**:..***.: *:*:*****.**:*** :****  *

Candid_WT    PVSLGVDGSPLRLERRGMNLGARVTGRPHIDMYPVCRQIFNLSRYTLEDVYLEITGREKK
Deep         KLPLGRDGSEPKMQRLGDMTAVEIKGRIHFDLYHVIRRTINLPTYTLEAVYEAIFGKPKE
              :.** ***  .::* *    .. :.** *:*:* * *. :**. **** **  * *. *:

Candid_WT    DIRVGEMAGIWDNPEKEKFKELIEYAMSDAESTLEIAITLLPLHYEISRITRELIYQSSR
Deep         KVYAHEIAEAWET--GKGLERVAKYSMEDAKVTYELGREFFPMEAQLSRLVGQPLWDVSR
             .: . *:*  *:.    : :: : :*:*.**: * *:.   ::*:   ::**:. : ::: **

Candid_WT    AGSGQRVESLLIKKAFEKSILVPNRPSDRVVNERQRKTYIGAYVVEPKRGIHDNILLFDF
Deep         SSTGNLVEWYLLRKAYERNELAPNKPDEREYERRLRESYAGGYVKEPEKGLWEGLVSLDF
             :.:*: **  *:.**:*.. *.**.*.:*   : * *::* *.** **:.*:.:.:: :**

Candid_WT    RSLYPSIIISHNIDPSTIDCECCPEDSYRSPTGHYFCKKKRGLIPETLNELVQRRIEVKK
Deep         RSLYPSIIITHNVSPDTLNREGCREYDVAPEVGHKFCKDFPGFIPSLLKRLLDERQEIKR
             *********:**:.*.*:: * * *  .   . .** ***.  *:**. *: *:: * *:*.

Candid_WT    GLKNEKNPERRRFLDVKQQALKLLANSM--------------------------------
Deep         KMKASKDPIEKKMLDYRQRAIKILANSILPEEWVPLIKNGKVKIFRIGDFVDGLMKANQG
              :* .*:*   ..:** .*.*:*:****:

Candid_WT    ------------------------------------------------------------
Deep         KVKKTGDTEVLEVAGIHAFSFDRKSKKARVMAVKAVIRHRYSGNVYRIVLNSGRKITITE

Candid_WT    ------------------------------------------------------------
Deep         GHSLFVYRNGDLVEATGEDVKIGDLLAVPRSVNLPEKRERLNIVELLLNLSPEETEDIIL

Candid_WT    ------------------------------------------------------------
Deep         TIPVKGRKNFFKGMLRTLRWIFGEEKRVRTASRYLRHLENLGYIRLRKIGYDIIDKEGLE
```

FIG. 9-1

```
Candid_WT     ------------------------------------------------------------
Deep          KYRTLYEKLVDVVRYNGNKREYLVEFNAVRDVISLMPEEELKEWRIGTRNGFRMGTFVDI

Candid_WT     ------------------------------------------------------------
Deep          DEDFAKLLGYYVSEGSARKWKNQTGGWSYTVRLYNENDEVLDDMEHLAKKFFGKVKRGKN

Candid_WT     ------------------------------------------------------------
Deep          YVEIPKKMAYIIFESLCGTLAENKRVPEVIFTSSKGVRWAFLEGYFIGDGDVHPSKRVRL

Candid_WT     ------------------------------------------------------------
Deep          STKSELLVNGLVLLLNSLGVSAIKLGYDSGVYRVYVNEELKFTEYRKKKNVYHSHIVPKD

Candid_WT     ------------------------------------------------------------
Deep          ILKETFGKVFQKNISYKKFRELVENGKLDREKAKRIEWLLNGDIVLDRVVEIKREYYDGY

Candid_WT     -------------------------YGYFGFPRARWYCRECAESITALGRKYI-LHTIDI
Deep          VYDLSVDEDENFLAGFGFLYAHNSYYGYYGYAKARWYCKECAESVTAWGREYIEFVRKEL
                                       ***:*:..*****.*****:** **:** :   ::

Candid_WT     VPKFGFDVIYGDTDSVYLIKPNITDRERVMKNAEHFLDKINSELPEAMELEFEGFYPRGI
Deep          EEKFGFKVLYIDTDGLYATIPG-AKPEEIKKKALEFVDYINAKLPGLLELEYEGFYVRGF
                ****.*:* ***.:*   *. :. * : *:*  *:* **::**  :***:**** **:

Candid_WT     FITKKRYALIDERGKLIVKGLETKRRDWANIAKDTQEKVLDALLKDKNPEKAASIVKDVI
Deep          FVTKKKYALIDEEGKIITRGLEIVRRDWSEIAKETQAKVLEAILKHGNVEEAVKIVKEVT
              *:***.****** **:*..***  ****::***:** ***:*:**  * *:*..***:*

Candid_WT     RNIKTGKIPLKDLAINTQITRGMAEYKTEGPHIVAAKKAMKRGLEFKQGNIVTYVVTKKG
Deep          EKLSKYEIPPEKLVIYEQITRPLHEYKAIGPHVAVAKRLAARGVKVRPGMVIGYIVLRGD
               ::.. :** :.*.*  **** : ***: ***:..**.   **::.. * :: *:* . .

Candid_WT     KSISDKARVIDFVE--EGDYDPDYYINNQVLPSVLRILEALGYSEDELK-------GLGK
Deep          GPISKRAILAEEFDLRKHKYDAEYYIENQVLPAVLRILEAFGYRKEDLRWQKTKQTGLTA
               .**..* : : .:  : .**.:***:*****:*******:** :::*.       **

Candid_WT     QMKLGGF
Deep          WLNIKKK
              .:::
```

FIG. 9-2

```
Candid_WT      MKKTLLDADYITREEKAVVRL-FYKTEEGREIQEVADFRPYMYVLPEEHDLKKLQREIK
Geobacillus    MKKKLVLIDGNSVAYRAFFALPLLHNDKGIHTNAVYGFTMMLNKILAEEQPTHLLVAFD
               ***.*:  *  :   .*.. * : :.::*   : * .*   :  :  * : .:*   :.

Candid_WT      ELKNITNVEIKRMIEGDREVEVLKVMVNQPRDVPNLRGLIKELEGCKEVREAHIPFAERY
Geobacillus    AGKTTFRHETFQEYKGGRQ--------QTPPELSEQFPLLRELLKAYRIPAYELDHYEAD
                 *.  . *  .  :*.*:        : * ::.:   *:.**  .  :    : . *

Candid_WT      LIDSGLIPMQDCENFDLRIAAFDMEVYNPRGEPKAERDPIIIISYADNRGLRRVWTYKTV
Geobacillus    DIIGTLAARAEQEGFEVKIIS-------------GDRDLTQLAS-----------RHVTV
                * . * .  : *.*::.* :             .:**   : *            : **

Candid_WT      ENLNLDYMEVLKDEREIIRRFIDTIREREIDIIVTYNGDNFDFPYLKERAEKHRIPV--S
Geobacillus    DITKKGITDIEPYTPETVREKYGLTPEQIVDLKGLMGDKSDNIPGVPGIGEKTAVKLLKQ
               :  : .  ::     * :*   .   *. :*:    .... ::* :   .**  : :  .

Candid_WT      LGVDGSPLRL--ERRGMNLGARVTGRPHIDMYPVCRQIFNLSR-----YTLEDVYLEITG
Geobacillus    FGTVENVLASIDEVKGEKLKENL--RQHRDLALLSKQLASICRDAPVELSLDDIVYEGQD
               :*.  . *    * .* :*  .:  * * *:  :..*: .:.*      :*:*:  *  .

Candid_WT      REK-----KDIRVGEMAGIWDNP--EKEKFKELIEYAMSD-------AESTLEIAITLLP
Geobacillus    REKVIALFKELGFQSFLEKMAAPAAEGEKPLEEMEFAIVDVITEEMLADKAALVVEVMEE
               ***     *:: . .:      *  * **  * :*:*: *       *:.:  :. .:

Candid_WT      LHYEISRITRELIYQSSRAGSGQRVESLLIKKAFEKSILVPNRPSDRVVNERQRKTYIGA
Geobacillus    NYHDAPIVGIALVNEHGR---------FFMRP---ETALADSQFLAWLADETKKKSMFDA
                ::: . :   *: : .*         :::.    :: *. ..   .:.:* :.*: :.*

Candid_WT      --YVVEPK-RGIHDNILLFDFRSLYPSIIISHNIDPSTID--CECCPEDSYRSPTGHYFC
Geobacillus    KRAVVALKWKGIELRGVAFDL--LLAAYLLNPAQDAGDIAAVAKMKQYEAVRSDEAVYGK
                  **  * .**  . : **:  * .: ::.   *.. *   .:    :: **  . *

Candid_WT      KKKRGLIPE-TLNELVQRRIEVKKGLKNE-----KNPERRRFLDVKQQALKLLANSMYGY
Geobacillus    GVKRSLPDEQTLAEHLVRKAAAIWALEQPFMDDLRNNEQDQLLTKLEQPLAAILAEM-EF
                 **.*  * ** * : *. . ..*::      .* *. .:*   :*.*  :  .*  :

Candid_WT      FGF----PRARWYCRECAESITAL--------GRKYILHTIDIVPKFGFD----VIYGDT
Geobacillus    TGVNVDTKRLEQMGSELAEQLRAIEQRIYELAGQEFNINSPKQLGVILFEKLQLPVLKKT
                *.     *  .   * **.: *:        *.:: ::: . :  :  *:     :  .*

Candid_WT      DSVYLIKPNITDR----ERVMKNAEHF--LDKINSELPEAM-------ELEFEGFYPRGI
Geobacillus    KTGYSTSADVLEKLAPHHEIVENILHYRQLGKLQSTYIEGLLKVVRPDTGKVHTMFNQAL
               .: *  ..:: :.      :::*  *:  *.*::*   *.:         :.  ::  ..:

Candid_WT      FITKK---------RYALIDERGKLIVKGLETKRRDWANIAKD-------------TQEK
Geobacillus    TQTGRLSSAEPNLQNIPIRLEEGRKIRQAFVPSEPDWLIFAADYSQIELRVLAHIADDDN
                 * .         . .:   * *. * :.: ..  **  :* *              :::
```

FIG. 10-1

```
Candid_WT      VLDALLKDKN-PEKAASIVKDVIRNIKTGKIPLKDLAINTQITRGMAEY---------KT
Geobacillus    LIEAFQRDLDIHTKTAMDIFHVSEEEVTANMRRQAKAVNFGIVYGISDYGLAQNLNITRK
               :::*: .* :   *:*  :  *  :  *.::  :  *:*  *. *:::*         ..

Candid_WT      EGPHIVAAKKAMKRGLEFKQGNIVT------YVVT--KKGKSISD---------------
Geobacillus    EAAEFIERYFASFPGVKQYMENIVQEAKQKGYVTTLLHRRRYLPDITSRNFNVRSFAERT
               *.. ::    *   *::    ***       **.*  :. . :.*

Candid_WT      ------KARVIDFVEEGDYDPDYYINNQVLPS--VLRILEA--LGYSEDELKGLGK----
Geobacillus    AMNTPIQGSAADIIKKAMIDLAARLKEEQLQARLLLQVHDELILEAPKEEIERLCELVPE
                     :. .*::::.  *    :::: * :  :*.: :   *  .::*:: * :

Candid_WT      ----------QMKLGGF---------
Geobacillus    VMEQAVTLRVPLKVDYHYGPTWYDAK
                          :*:. .
```

FIG. 10-2

```
Candid_WT       MKKTLLDADYITREEKAVVRLFYKTEEGREIQEVADFRPYMY-VLPEEHDLKKLQREIK
Pfu             ---MILDVDYITEEGKPVIRLFKKENGKFKIEHDRTFRPYIYALLRDDSKIEEVKKITG
                    :**.**** * *.*:*** * :   :*:    ****:* :* :: .:::::.

Candid_WT       E----LKNITNVE-IKRMIEGDREVEVLKVMVNQPRDVPNLRGLIKELEGCKEVREAHIP
Pfu             ERHGKIVRIVDVEKVEKKFLG-KPITVWKLYLEHPQDVPTIREKVREHPAVVDIFEYDIP
                *    : .*.:** ::. : * . : * *: :::*.***.:*  :.*  .  :: *  **

Candid_WT       FAERYLIDSGLIPMQDCENFDLRIAAFDMEVYNPRGEPKAERDPIIIISYADNRGLRRVW
Pfu             FAKRYLIDKGLIPMEGEE--ELKILAFDIETLYHEGE-EFGKGPIIMISYADENE-AKVI
                **:*****.*****:. *  :*.* ***:*.    ** :  ..***:*****:.   .*

Candid_WT       TYKIVENLNLDYMEVLKDEREIIRRFIDTIREREIDIIVTYNGDNFDFPYLKERAEKHRI
Pfu             TWK---NIDLPYVEVVSSEREMIKRFLRIIREKDPDIIVTYNGDSFDFPYLAKRAEKLGI
                *:*   *::* *:**:..***:*.**:  ***.: *********.****** :****  *

Candid_WT       PVSLGVDGSPLRLERRGMNLGARVTGRPHIDMYPVCRQIFNLSRYTLEDVYLEITGREKK
Pfu             KLTIGRDGSEPKMQRIGDMTAVEVKGRIHFDLYHVITRTINLPTYTLEAVYEAIFGKPKE
                 :::* ***  .::* *    ..*.** *:*:* *  . :**. **** **  * *. *:

Candid_WT       DIRVGEMAGIWDNPEKEKFKELIEYAMSDAESTLEIAITLLPLHYEISRITRELIYQSSR
Pfu             KVYADEIAKAWES--GENLERVAKYSMEDAKATYELGKEFLPMEIQLSRLVGQPLWDVSR
                .: ..*:*  *:.   *::: : :*:*.**::* *:.  :**:  ::**:. : ::: **

Candid_WT       AGSGQRVESLLIKKAFEKSILVPNRPSDRVVNERQRKTYIGAYVVEPKRGIHDNILLFDF
Pfu             SSTGNLVEWFLLRKAYERNEVAPNKPSEEEYQRRLRESYTGGFVKEPEKGLWENIVYLDF
                :.:*: ** :*:.**:*.. :.**.**:   : * *::* *.:* **:.*:.:**: :**

Candid_WT       RSLYPSIIISHNIDPSTIDCECCPEDSYRSPTGHYFCKKKRGLIPETLNELVQRRIEVKK
Pfu             RALYPSIIITHNVSPDTLNLEGCKNYDIAPQVGHKFCKDIPGFIPSLLGHLLEERQKIKT
                *:*******:**:.*.*:: * * : .  . .** ***.  *:**. *. *:: * ::*.

Candid_WT       GLKNEKNPERRRFLDVKQQALKLLANSMYGYFGFPRARWYCRECAESITALGRKYI-LHT
Pfu             KMKETQDPIEKILLDYRQKAIKLLANSFYGYYGYAKARWYCKECAESVTAWGRKYIELVW
                 :*: ::*  . :** .*:*:******:***:*:..*****.*****:** ***** *

Candid_WT       IDIVPKFGFDVIYGDTDSVYLIKPNITDRERVMKNAEHFLDKINSELPEAMELEFEGFYP
Pfu             KELEEKFGFKVLYIDTDGLYATIPG-GESEEIKKKALEFVKYINSKLPGLLELEYEGFYK
                 ::  ****.*:* ***.:*   *.  : * : *:*  *:. ***:**  :***:****

Candid_WT       RGIFITKKRYALIDERGKLIVKGLETKRRDWANIAKDTQEKVLDALLKDKNPEKAASIVK
Pfu             RGFFVTKKRYAVIDEEGKVITRGLEIVRRDWSEIAKETQARVLETILKHGDVEEAVRIVK
                **:*:******:*** **:*..***  ****::***:** .**:::**  : *:*. ***
```

FIG. 11-1

```
Candid_WT       DVIRNIKTGKIPLKDLAINTQITRGMAEYKTEGPHIVAAKKAMKRGLEFKQGNIVTYVVT
Pfu             EVIQKLANYEIPPEKLAIYEQITRPLHEYKAIGPHVAVAKKLAAKGVKIKPGMVIGYIVL
                :**.:: . :** :.***   **** : ***: ***:..***    .*:::* * :: *:*

Candid_WT       KKGKSISDKARVIDFVE--EGDYDPDYYINNQVLPSVLRILEALGYSEDELK-------G
Pfu             RGDGPISNRAILAEEYDPKKHKYDAEYYIENQVLPAVLRILEGFGYRKEDLRYQKTRQVG
                . . .**:.* : :   :  : .**.:***:*****:******.:** :::*.      *

Candid_WT       LGKQMKLGGF
Pfu             LTSWLNIKKS
                *  ..:::
```

FIG. 11-2

```
Candid_WT       MKKTLLDADYITREEKAVVRLFYKTEEGREIQEVADFRPYMYVLPEE----HDLKKLQR
Pyroc_abyssi    ---MIIDADYITEDGKPIIRIFKKEKGEFKVEYDRTFRPYIYALLKDDSAIDEVKKITA
                    ::****** : *.::*:* *  :    :::     ****:*.* ::      ::**:

Candid_WT       EIK-ELKNITNVE-IKRMIEGDREVEVLKVMVNQPRDVPNLRGLIKELEGCKEVREAHIP
Pyroc_abyssi    ERHGKIVRITEVEKVQKKFLG-RPIEVWKLYLEHPQDVPAIREKIREHPAVVDIFEYDIP
                * : :: .**:** ::. : * * :** *: :::*.*** :*  *.*  .  :: *  **

Candid_WT       FAERYLIDSGLIPMQDCENFDLRIAAFDMEVYNPRGEPKAERDPIIIISYADNRGLRRVW
Pyroc_abyssi    FAKRYLIDKGLTPMEGNE--ELTFLAVDIETLYHEGE-EFGKGPIIMISYADEEG-AKVI
                **:*****.** **:. *  :* : *.*:*.     ** :   ..***:*****: *   .*

Candid_WT       TYKTVENLNLDYMEVLKDEREIIRRFIDTIREREIDIIVTYNGDNFDFPYLKERAEKHRI
Pyroc_abyssi    TWKSID---LPYVEVVSSEREMIKRLVKVIREKDPDVIITYNGDNFDFPYLLKRAEKLGI
                *:*:::    * *:**:..***:*.*::..***.: *:*:************ :****  *

Candid_WT       PVSLGVDGSPLRLERRGMNLGARVTGRPHIDMYPVCRQIFNLSRYTLEDVYLEITGREKK
Pyroc_abyssi    KLPLGRDNSEPKMQRMGDSLAVEIKGRIHFDLFPVIRRTINLPTYTLEAVYEAIFGKSKE
                 :.** *.*  .::* * .*.. :.** *:*::** *. :**. **** **  * *..*:

Candid_WT       DIRVGEMAGIWDNPEKEKFKELIEYAMSDAESTLEIAITLLPLHYEISRITRELIYQSSR
Pyroc_abyssi    KVYAHEIAEAWET--GKGLERVAKYSMEDAKVTFELGKEFFPMEAQLARLVGQPVWDVSR
                .: . *:*  *:.   : :: : :*:*.**: *:*:.   ::*:  :::*:. : ::: **

Candid_WT       AGSGQRVESLLIKKAFEKSILVPNRPSDRVVNERQRKTYIGAYVVEPKRGIHDNILLFDF
Pyroc_abyssi    SSTGNLVEWFLLRKAYERNELAPNKPDEREYERRLRESYEGGYVKEPEKGLWEGIVSLDF
                :.:*: ** :*:.**:*.. *.**.*.:*  : * *::* *.** **:.*:.:.*: :**

Candid_WT       RSLYPSIIISHNIDPSTIDCECCPEDSYRSPTGHYFCKKKRGLIPETLNELVQRRIEVKK
Pyroc_abyssi    RSLYPSIIITHNVSPDTLNRENCKEYDVAPQVGHRFCKDFPGFIPSLLGNLLEERQKIKK
                *********:**:.*.*:: * * *  .   . .** ***.  *:**. *.:*:: * ::**

Candid_WT       GLKNEKNPERRRFLDVKQQALKLLANSMYGYFGFPRARWYCRECAESITALGRKYILHTI
Pyroc_abyssi    RMKESKDPVEKKLLDYRQRAIKILANSYYGYYGYAKARWYCKECAESVTAWGRQYIDLVR
                 :*:.*:*  ..:** .*.*:*:**** ***:*:..*****.*****:** **:**   .

Candid_WT       DIVPKFGFDVIYGDTDSVYLIKPNITDRERVMKNAEHFLDKINSELPEAMELEFEGFYPR
Pyroc_abyssi    RELESRGFKVLYIDTDGLYATIPG-AKHEEIKEKALKFVEYINSKLPGLLELEYEGFYAR
                  : . **.*:* ***.:*   *. :..* : ::* :*:: ***:**  :***:****.*

Candid_WT       GIFITKKRYALIDERGKLIVKGLETKRRDWANIAKDTQEKVLDALLKDKNPEKAASIVKD
Pyroc_abyssi    GFFVTKKKYALIDEEGKIVTRGLEIVRRDWSEIAKETQAKVLEAILKHGNVDEAVKIVKE
                *:*:***.****** **::..***  ****::***:** ***:*:**  * ::*..***:
```

FIG. 12-1

```
Candid_WT       VIRNIKTGKIPLKDLAINTQITRGMAEYKTEGPHIVAAKKAMKRGLEFKQGNIVTYVVTK
Pyroc_abyssi    VTEKLSKYEIPPEKLVIYEQITRPLSEYKAIGPHVAVAKRLAAKGVKVKPGMVIGYIVLR
                *  ::.. :** :.*.*  **** ::***: ***:..**.   .*::.* * :: *:* .

Candid_WT       KGKSISDKARVIDFVE--EGDYDPDYYINNQVLPSVLRILEALGYSEDELK-GLGKQMKL
Pyroc_abyssi    GDGPISKRAIAIEEFDPKKHKYDAEYYIENQVLPAVERILRAFGYRKEDLKYQKTKQVGL
                 . .**..* .*: .:  : .**.:***:*****:* *** *:** :::**    **: *

Candid_WT       GGF---
Pyroc_abyssi    GAWLKF
                *.:
```

FIG. 12-2

```
Candid_WT       MKKTLLDADYITREEKAVVRLF---YKTEEGREIQEVADFRPYMYVL-PEEHDLKKLQRE
RB69            ------MKEFYLTVEQIGDSIFERYIDSNGRERTREVEYKPSLFAHCPESQATKYF----
                        ::    *:    :*  *  .:***    .::.* ::.  **.:  * :

Candid_WT       IKELKNITNVEIKRMIEGDREVEVLKVMVNQPRDVPNLRGLIKELEGCKEVREAHIPFAE
RB69            -----DIYGKPCTR--------KLFANMRDASQWIKRMEDIGLEALGMDDFKLAYLSDTY
                     :* .   .*        :::  * : .. : .: .:  *  * .:.. *::. :

Candid_WT       RYLIDSGLIPMQDCENFDLRIAAFDMEVYNPRG--EPKAERDPIIIISYADN--------
RB69            NYEI--------KYDHTKIRVANFDIEVTSPDGFPEPSQAKHPIDAITHYDSIDDRFYVF
                .* *        . :: .:*:* **:** .* *  **.  . **  *:: *.

Candid_WT       ------RGLRRVWTYKTVENL--------------NLDYMEVLKDEREIIRRFIDTIRER
RB69            DLLNSPYGNVEEWSIEIAAKLQEQGGDEVPSEIIDKIIYMP-FDNEKELLMEYLNFWQQK
                       *    *: : . :*              :: **  :.:*.*::  :::  .:.

Candid_WT       EIDIIVTYNGDNFDFPYLKERAE---------------KHRIPVSLGVDGSPLRLERRGM
RB69            TPVILTGWNVESFDIPYVYNRIKNIFGESTAKRLSPHRKTRVKVIENMYGSREIITLFGI
                   *:. :* :.**:**: :* :               * *: *  .: **   :   *:

Candid_WT       NLGARVTGRPHIDMYPVCRQIFNLSRYTLEDVYLEITGREKKDIRVGEMAGIWDNP----
RB69            SV------LDYIDLYKKF-SFTNQPSYSLDYI-------SEFELNVGKLK--YDGPISKL
                .:        :**:*    .: * . *:*: :       .: ::.**::   :*.*

Candid_WT       EKEKFKELIEYAMSDAESTLEIAI--TLLPLHYEI---SRITRELIYQSSRAGSGQRVES
RB69            RESNHQRYISYNIIDVYRVLQIDAKRQFINLSLDMGYYAKIQIQSVFSPIKT-----WDA
                 :.:.:  *.* : *.  .*:*     :: *  ::   :.*  : ::.. .:      ::

Candid_WT       LLIKKAFEKSILVPNRPSDRVVNERQRKTYIGAYVVEPKRGIHDNILLFDFRSLYPSIII
RB69            IIFNSLKEQNKVIPQGRSHPV------QPYPGAFVKEPIPNRYKYVMSFDLTSLYPSIIR
                ::::.  *:. ::*:  *  *      :.* **:* **  . :. :: **: *******

Candid_WT       SHNIDPSTI--------------DCECCPEDSYR-SPTGHYFCKKKRGLIPETLNELVQR
RB69            QVNISPETIAGTFKVAPLHDYINAVAERPSDVYSCSPNGMMYYKDRDGVVPTEITKVFNQ
                . **.*.**                   *.* *  **.*  : *.. *::*  :.::.:.

Candid_WT       RIE--------------VKKGLKN------------------EKNPERRRFLDVK-----
RB69            RKEHKGYMLAAQRNGEIIKEALHNPNLSVDEPLDVDYRFDFSDEIKEKIKKLSAKSLNEM
                * *              :*:.*:*                  ::  *. . *..*

Candid_WT       --------------QQALKLLANSMYGYFGFPRARWYCRECAESITALGRKYILHTIDIV
RB69            LFRAQRTEVAGMTAQINRKLLINSLYGALGNVWFRYYDLRNATAITTFGQMALQWIERKV
                              *   *** **:** :*  . *:*    * :**::*.  : .    *

Candid_WT       PKF-----GFD----VIYGDTDSVYLIKPNITDR--ERVMKNAEHFLDKINSELPEAMEL
RB69            NEYLNEVCGTEGEAFVLYGDTDSIYVSADKIIDKVGESKFRDTNHWVDFLDKFARERMEP
                 ::     * :    *:******:*:   :* *.  *  :.:::*::*  ::.   * **
```

FIG. 13-1

```
Candid_WT           EFE-GFYPR-----------------------------GIFITKKRYAL--IDERG----
RB69                AIDRGFREMCEYMNNKQHLMFMDREAIAGPPLGSKGIGGFWTGKKRYALNVWDMEGTRYA
                     :: **                                *::  ******   *  *

Candid_WT           --KLIVKGLETKRRDWANIAKDTQEKVLDALLKDKNPEKAASIVKDVIRNIKTGKIPLKD
RB69                EPKLKIMGLETQKSSTPKAVQKALKECIRRMLQEGEES-----LQEYFKEFEKEFRQLNY
                      ** : ****:. . .: .:.: :: :  :*:: : .     ::: :.:::.    *:

Candid_WT           LAINT-QITRGMAEYKTEG----------PHIVAAKKAMKRGLEFKQ---GNIVTYVVTK
RB69                ISIASVSSANNIAKYDVGGFPGPKCPFHIRGILTYNRAIKGNIDAPQVVEGEKVYVLPLR
                    ::* : . :..:*:*.. *            *:: :.*:* .::  *   *: *  :  .

Candid_WT           KGKSISDKA-------RVIDFVEEGDYDPDYYINNQVL--PSVLRILEALGYSED-ELKG
RB69                EGNPFGDKCIAWPSGTEITDLIKD---DVLHWMDYTVLLEKTFIKPLEGFTSAAKLDYEK
                    :*:.:.**.        : *::::   *  ::::  **   :.:. **.:  : . : :

Candid_WT           LGKQMKLGGF
RB69                KASLFDMFDF
                     .. :.: .*
```

FIG. 13-2

Spacer:
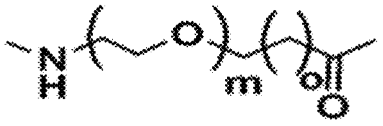
Linkers:
11 atom Linker:
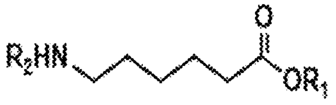
16 atom Linker:
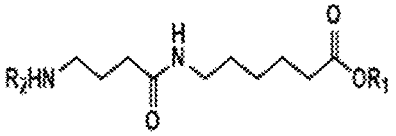
23 atom Linker:
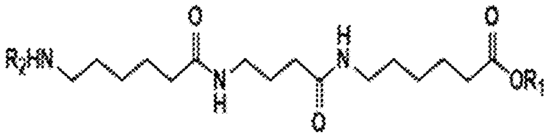
N3 Linker:
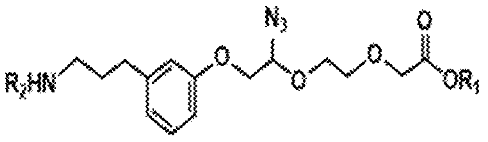
FIG. 16A

Linker 1:
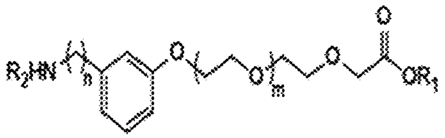
Linker 2:
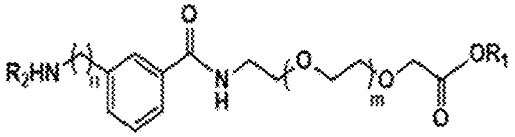
Linker 3:
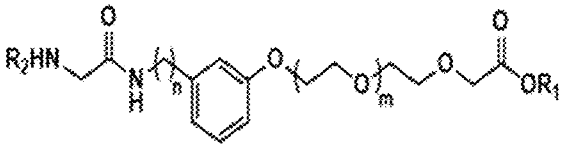
Linker 4:
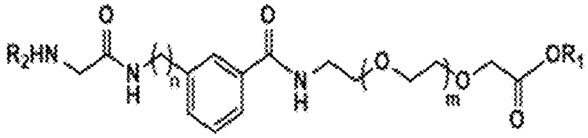
Linker 5:
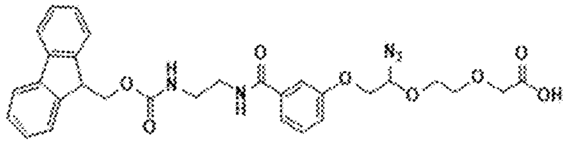
Linker 6:
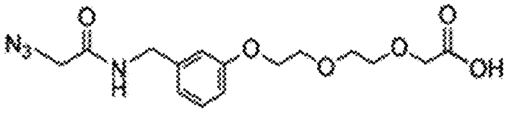
Molecular Weight: 352.35
Linker 7:
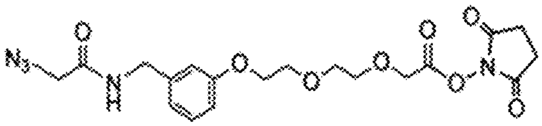
Molecular Weight: 449.42
Linker 8:
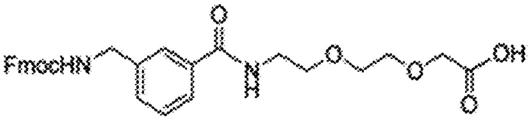
Molecular Weight: 518.57
Linker 9:
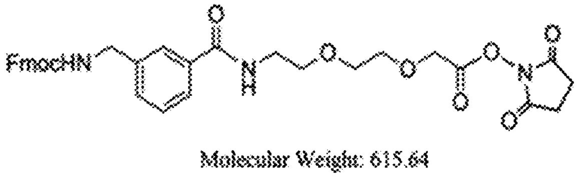
Molecular Weight: 615.64
FIG. 16B dNTP-PA-$NH_2$:
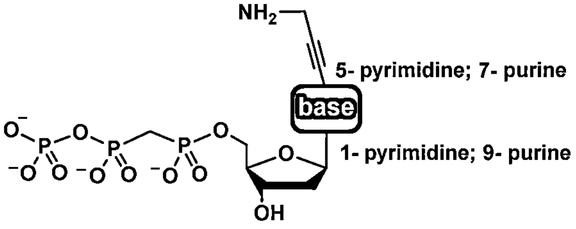
dNTP-PA-11 Atom Linker-$NH_2$:
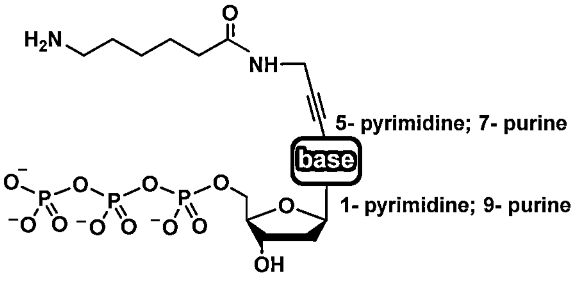
dNTP-PA-16 Atom Linker-$NH_2$:
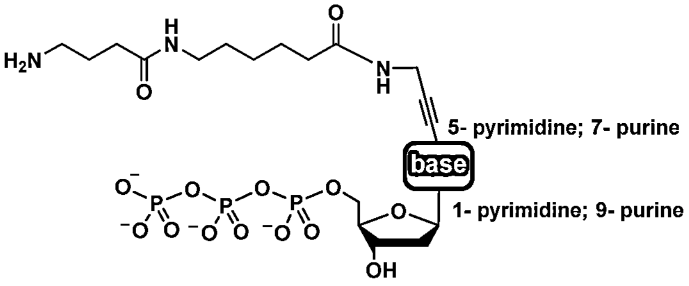
dNTP-PA-23 Atom Linker-$NH_2$:
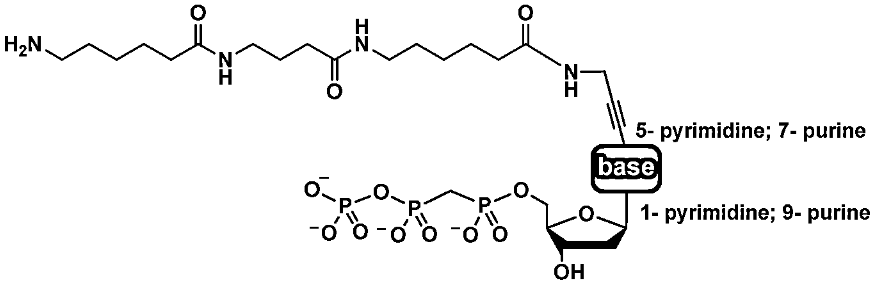
FIG. 17A dNTP-PA-N3 Linker-$NH_2$:
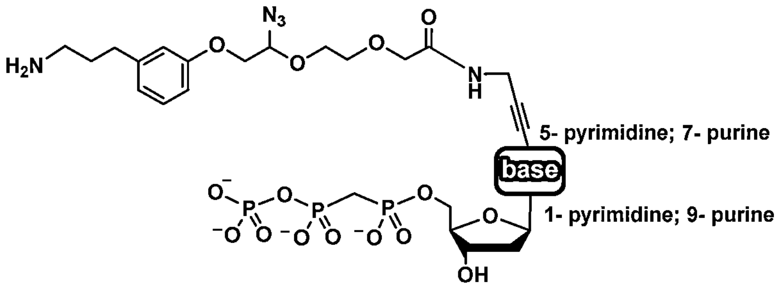
dNTP-PA-Linker 1-$NH_2$:
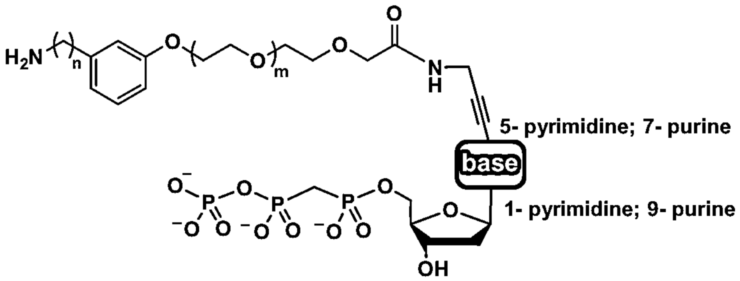
dNTP-PA-Linker 2-$NH_2$:
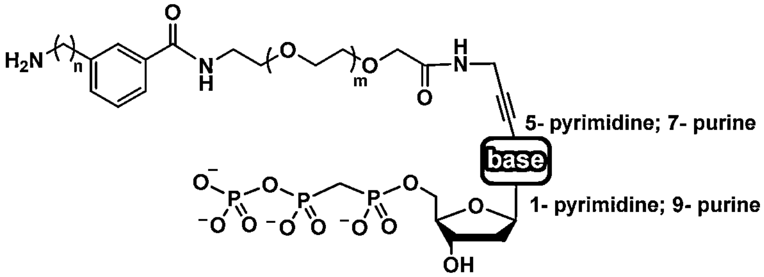
dNTP-PA-Linker 3-$NH_2$:
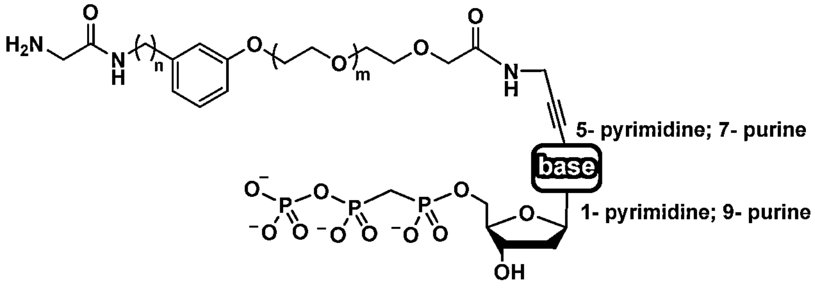
FIG. 17B dNTP-PA-Linker 4-$NH_2$:
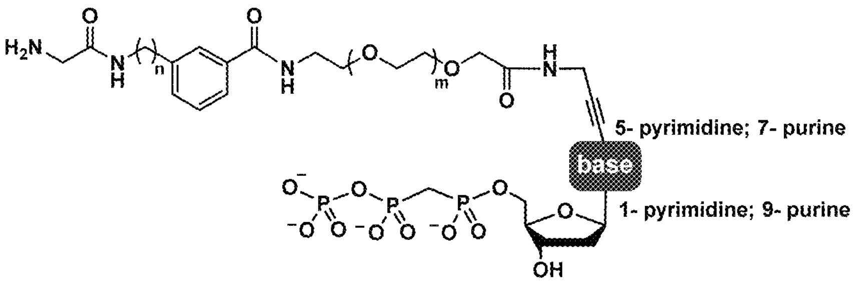
dNTP-PA-N3 Linker-$NH_2$:
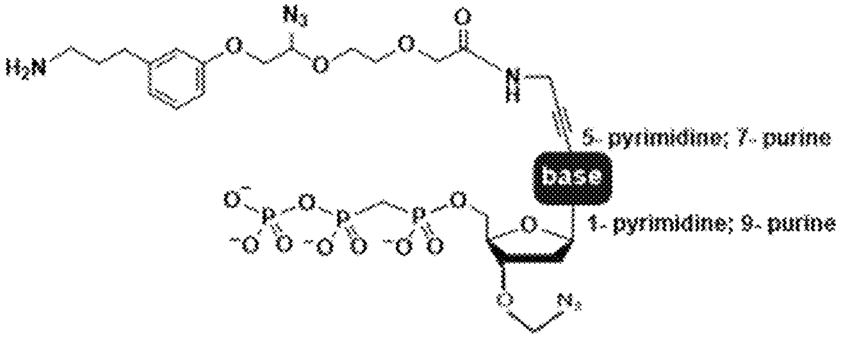
FIG. 17C

ENGINEERED POLYMERASES

CROSS REFERENCE TO RELATED APPLICATIONS

This application claims the benefit of and priority to U.S. Provisional Application No. 63/212,540, filed on Jun. 18, 2021, which is incorporated herein by reference in its entirety for all purposes.

Throughout this application, various publications, patents, and/or patent applications are referenced. The disclosures of the publications, patents and/or patent applications are hereby incorporated by reference in their entireties into this application in order to more fully describe the state of the art to which this disclosure pertains.

SEQUENCE LISTING

The instant application contains a Sequence Listing which has been submitted electronically in ASCII format and is hereby incorporated by reference in its entirety. Said ASCII copy, created on May 31, 2022, is named 50108US_CRF_sequence listing and is 2524 kilobytes in size.

TECHNICAL FIELD

The present disclosure provides mutant polymerases that are engineered for improved thermal stability, exhibit improved binding of nucleotide analogs and/or improved binding and incorporation of nucleotide analogs, and improved uracil-tolerance. Exemplary nucleotide analogs include nucleotides comprising a 3' chain terminating moiety. The mutant polymerases exhibit increased incorporation rates, compared to wild type polymerases.

BACKGROUND

Next-generation sequencing (NGS) techniques have become a powerful tool for acquiring sequencing data used in molecular biology techniques, taxonomy, agriscience, medical diagnostics, and the development of new therapies. The present disclosure provides engineered polymerase that are useful for conducting any nucleic acid sequencing method that employs labeled or non-labeled chain terminating nucleotides, where the chain terminating nucleotides include a 3'-O-azido group (or 3'-O-methylazido group) or any other type of bulky blocking group at the sugar 3' position. For example, the engineered polymerases can be used to conduct sequencing-by-avidity methods (SBA) using labeled multivalent molecules and non-labeled chain terminating nucleotides. Additionally, the engineered polymerases can be used for conducting sequencing-by-synthesis (SBS) methods which employ labeled chain-terminating nucleotides, and for conducting sequencing-by-binding methods (SBB) which employ non-labeled chain-terminating nucleotides.

The addition of a single nucleotide to a strand of DNA alone does not produce enough signal to easily detect. Currently available SBS technologies overcome this problem by increasing the signal to noise of the nucleotide addition coupled to a detection method with sufficient sensitivity to make an accurate base call. The most commercially successful platforms employ monoclonal template DNA amplification in a spatially constrained matrix to generate discrete DNA islands that contain multiple copies of a sequence to interrogate. The result of this amplification is a "colony" of DNA copies such that addition of a single DNA base on all of the copies concentrates the detection modality in a manner sufficient to overcome the signal to noise problem. The sequencing of multiple spatially constrained identical copies of DNA further increases the reliance on a controlled stepping mechanism to ensure that one, and only one, nucleotide bases can be added to ensure that all of the copies within a DNA colony remain at the same position (N, N+1, N+2, N+3, etc. . . . ) relative to each other.

The molecular engine needed to perform SBS is a DNA polymerase. In vivo, this class of enzymes is responsible for DNA replication and maintaining genome integrity. Under native conditions DNA dependent DNA polymerases (dDdP's) catalyze the addition of deoxynucleotide triphosphates (dNTP) to DNA in a 5' to 3' direction creating phosphodiester bonds between the 3' hydroxyl of the primer DNA terminus and the 5' alpha phosphate of the incoming nucleotide. This chemistry occurs with high fidelity for the correct Watson-Crick base pair due to hydrogen bonding between the correct incoming dNTP and the templating base. This "correct" base pairing induces a conformational change in the enzyme that aligns catalytic amino acids to efficiently perform phosphodiester bond formation. The newly added dNTP also possesses a 3'OH which is used in the next round of catalysis to further extend the DNA strand.

To ensure that only a single dNTP is added to the growing strands of DNA per SBS cycle a reversibly terminated dNTP is employed. These bases contain modifications to the 3' hydroxyl of the dNTP that block subsequent rounds of incorporation. The most commercially successful reversible terminator is the 3' methylazido, however others including 3' aminoallyl, and 3' oxyamine has also been used. Each of these reversibly terminated dNTPs function in the same manner; once incorporated the bulky 3' block inhibits addition of the next nucleotide because no 3' hydroxyl is present. When exposed to a catalyst, the 3' block reacts to re-generate a 3' hydroxyl capable of forming a new phosphodiester bond during the next cycle. While effective, these bulky 3' modifications present a challenge for the polymerase.

The evolutionary need for high fidelity genome replication and stability has resulted in polymerases that only incorporate a non-Watson-Crick base pair in every $10^4$-$10^7$ incorporation events. Polymerases often also need to discriminate between vast excesses of nucleotides in the cellular environment. Discrimination between nucleotides is typically done through a steric gate where the presence of a 2'hydroxyl sterically clashes with an amino acid side chain at the nucleotide binding site to select against nucleotide binding and catalysis. Additionally, damage or modification to the 3' hydroxyl of the nucleotide is also sensed by the enzyme because bases containing non-viable 3' hydroxyls can act as chain terminators that inhibit DNA synthesis. Discrimination of these unwanted bases occurs through a kinetic pathway where incorrect nucleotide substrates bind with a weaker overall affinity and phosphodiester bond formation occurs at rates $10^2$-$10^4$ orders of magnitude more slowly. This occurs due to the lack of an induced fit that would properly align catalytic amino acids for bond formation. As a result, naturally evolved polymerases incorporate reversible chain-terminator nucleotides poorly.

SUMMARY

The present disclosure provides for mutant polymerases that are engineered for improved thermal stability, exhibit improved binding of nucleotide analogs and/or improved binding and incorporation of nucleotide analogs, and improved uracil-tolerance. The engineered polymerases may be used in a variety of situations and may have various features, as described in more detail below.

The present disclosure provides binding complexes (e.g., ternary complexes) each including a nucleotide. The present disclosure provides a plurality of ternary complexes each comprising: a mutant or wild type DNA polymerase bound to a nucleic acid duplex and a nucleotide, wherein the nucleic acid duplex comprises a nucleic acid template molecule hybridized to a nucleic acid primer, wherein in the ternary complex the nucleotide is bound to the 3' end of the nucleic acid primer at a position that is opposite a complementary nucleotide in the nucleic acid template molecule. In some embodiments, in the ternary complex, the nucleotide is bound to the nucleic acid duplex and has not undergone polymerase-catalyzed incorporation, or the nucleotide is bound to the nucleic acid duplex and has undergone polymerase-catalyzed incorporation. In some embodiments, the wild type DNA polymerase comprises the amino acid sequence of SEQ ID NO: 1. In some embodiments, the mutant DNA polymerase comprises an amino acid sequence that is at least 85% identical to SEQ ID NO: 1.

In some embodiments, the mutant DNA polymerase is from Candidatus Altiarchaeales archaeon and comprises the amino acid sequence of any one of SEQ ID NOS: 2-274 or 288-375 or and 385-397. In some embodiments, the mutant polymerase includes the amino acid substitutions D141A and E143A (Asp141Ala and Glu143A1a). In some embodiments, the ternary complex remains stable without dissociation (or exhibiting reduced dissociation) of the mutant or wild type polymerase from the nucleic acid duplex, and the stable ternary complex exhibits a persistence time of more than 0.1, 0.2, 0.3, 0.4, 0.5, 0.6, 0.7, 0.8, 0.9 or 1 second. In some embodiments, the plurality of ternary complexes further comprises a plurality of non-catalytic divalent cations or a plurality of catalytic divalent cations. In some embodiments, the plurality of non-catalytic divalent cations comprises strontium, barium and/or calcium. In some embodiments, the catalytic divalent cation comprises magnesium and/or manganese.

In some embodiments, the mutant polymerase from Candidatus Altiarchaeales archaeon comprises an amino acid sequence having at least 85% sequence identity, at least 90% sequence identity, or at least 95% sequence identity, or at least 96% sequence identity, or at least 97% sequence identity, or at least 98% sequence identity, or at least 99% sequence identity, or at least 99.1% sequence identity, or at least 99.2% sequence identity, or at least 99.3% sequence identity, or at least 99.4% sequence identity, or at least 99.5% sequence identity, or at least 99.6% sequence identity, or at least 99.7% sequence identity, or at least 99.8% sequence identity, or a higher percent sequence identity to SEQ ID NO: 1, 393 or 391, where the mutant DNA polymerase comprises an amino acid substitution at any one or any combination of two or more positions selected from a group consisting of Leu416, Tyr417, Pro418, Ala493, Arg515, Ile529 and Asn567. In some embodiments, the mutant polymerases include amino acid substitutions D141A and E143A which can confer exonuclease-minus activity. In some embodiments, the mutant polymerases exhibit desirable characteristics compared to a polymerase having a wild type amino acid backbone sequence (e.g., SEQ ID NO: 1 or 391). For example, the mutant polymerases exhibit increased thermal stability (Tm). In another example, the mutant polymerases exhibit increased incorporation rates of nucleotide analogs comprising a chain terminating moiety (e.g., blocking moiety) at the sugar 2' position and/or at the 3' sugar position. In yet another example, the mutant polymerases exhibit increased uracil-tolerance. One or more features described in this paragraph may appear in any example mutant polymerases in various embodiments described in this disclosure. The features described in this paragraph are referred to as "example mutant polymerase features" throughout this disclosure.

In some embodiments, in the ternary complexes which include nucleotides, the plurality of immobilized complexed polymerases comprise nucleic acid template molecules having the same target of interest sequence or different target of interest sequences.

In some embodiments, in the ternary complexes which include nucleotides, the nucleotide comprises an aromatic base, a five-carbon sugar, and 1-10 phosphate groups, wherein the aromatic base of the nucleotide comprises adenine, guanine, cytosine, thymine or uracil. The nucleotides comprise dATP, dGTP, dCTP, dTTP or dUTP. The nucleotide can be labeled with a fluorophore. The nucleotide can lack a fluorophore.

In some embodiments, in the ternary complexes which include nucleotides, the nucleotide comprises a chain terminating moiety. In some embodiments, the chain terminating moiety may be attached to the 3'—OH sugar position via a cleavable moiety. In some embodiments, the chain terminating moiety can inhibit polymerase-catalyzed incorporation of a subsequent nucleotide unit or free nucleotide in a nascent strand during a primer extension reaction. In some embodiments, the chain terminating moiety is attached to the 3' sugar hydroxyl position where the sugar comprises a ribose or deoxyribose sugar moiety. In some embodiments, the chain terminating moiety is removable/cleavable from the 3' sugar hydroxyl position to generate a nucleotide having a 3'OH sugar group which is extendible with a subsequent nucleotide in a polymerase-catalyzed nucleotide incorporation reaction. In some embodiments, the chain terminating moiety comprises an alkyl group, alkenyl group, alkynyl group, allyl group, aryl group, benzyl group, azide group, amine group, amide group, keto group, isocyanate group, phosphate group, thio group, disulfide group, carbonate group, urea group, or silyl group. In some embodiments: the chain terminating moieties alkyl, alkenyl, alkynyl and allyl are cleavable/removable with tetrakis(triphenylphosphine)palladium(0) ($Pd(PPh_3)_4$) with piperidine, or with 2,3-Dichloro-5,6-dicyano-1,4-benzo-quinone (DDQ); the chain terminating moieties aryl and benzyl are cleavable/removable with H2 Pd/C; the chain terminating moieties amine, amide, keto, isocyanate, phosphate, thio, disulfide are cleavable/removable with a thiol reagent which comprises beta-mercaptoethanol or dithiothritol (DTT); the chain terminating moieties amine, amide, keto, isocyanate, phosphate, thio, disulfide are cleavable/removable with a phosphine reagent which comprises Tris(2-carboxyethyl) phosphine (TCEP), bis-sulfo triphenyl phosphine (BS-TPP), or Tri(hydroxyproyl)phosphine (THPP); the chain terminating moieties amine, amide, keto, isocyanate, phosphate, thio, disulfide are cleavable/removable with 4-dimethylamino-pyridine (4-DMAP); the chain terminating moiety carbonate is cleavable/removable with potassium carbonate ($K_2CO_3$) in MeOH, with triethylamine in pyridine, or with Zn in acetic acid (AcOH); and the chain terminating moieties urea and silyl are cleavable with tetrabutylammonium fluoride, pyridine-HF, with ammonium fluoride, or with triethylamine trihydrofluoride. In some embodiments, a chain terminating moiety may be cleaved with nitrous acid. In some embodiments, a chain terminating moiety may be cleaved using a solution comprising nitrite, such as, for example, a combination of nitrite with an acid such as acetic acid, sulfuric acid, or nitric acid. In some further embodiments, said solution may comprise an organic acid. One or more features described in this paragraph may appear in any example chain terminating moieties in various embodiments described in this disclosure. The features described in this paragraph are referred to as "chain terminating moiety embodiments" throughout this disclosure.

In some embodiments, in the ternary complexes which include nucleotides, the nucleotide comprises a chain terminating moiety attached to the 3'—OH sugar position via a cleavable moiety, and wherein the chain terminating moiety comprises an azide, azido or azidomethyl group. For example, in some embodiments, the chain terminating moiety comprises a 3'-O-azido or 3'-O-azidomethyl group. In some embodiments: the chain terminating moieties azide, azido and azidomethyl group are cleavable/removable with a phosphine compound which comprise a derivatized tri-alkyl phosphine moiety, derivatized tri-aryl phosphine moiety, Tris(2-carboxyethyl)phosphine (TCEP), bis-sulfo triphenyl phosphine (BS-TPP) or Tri(hydroxyproyl)phosphine (THPP); and the chain terminating moieties azide, azido and azidomethyl group are cleavable/removable with 4-dimethylaminopyridine (4-DMAP). In some embodiments, in the system, the nucleotide analog comprise a chain terminating moiety which is selected from a group consisting of 3'-deoxy nucleotides, 2',3'-dideoxynucleotides, 3'-methyl, 3'-azido, 3'-azidomethyl, 3'-O-azidoalkyl, 3'-O-ethynyl, 3'-O-aminoalkyl, 3'-O-fluoroalkyl, 3'-fluoromethyl, 3'-difluoromethyl, 3'-trifluoromethyl, 3'-sulfonyl, 3'-malonyl, 3'-amino, 3'-O-amino, 3'-sulfhydral, 3'-aminomethyl, 3'-ethyl, 3'butyl, 3'-tert butyl, 3'-Fluorenylmethyloxycarbonyl, 3' tert-Butyloxycarbonyl, 3'-O-alkyl hydroxylamino group, 3'-phosphorothioate, and 3-O-benzyl, or derivatives thereof. In some embodiments, a chain terminating moiety comprising one or more of a 3'-O-amino group, a 3'-O-aminomethyl group, a 3'-O-methylamino group, or derivatives thereof may be cleaved with nitrous acid, through a mechanism utilizing nitrous acid, or using a solution comprising nitrous acid. In some embodiments, a chain terminating moiety comprising one or more of a 3'-O-amino group, a 3'-O-aminomethyl group, a 3'-O-methylamino group, or derivatives thereof may be cleaved using a solution comprising nitrite. In some embodiments, for example, nitrite may be combined with or contacted with an acid such as acetic acid, sulfuric acid, or nitric acid. In some further embodiments, for example, nitrite may be combined with or contacted with an organic acid such as, for example, formic acid, acetic acid, propionic acid, butyric acid, isobutyric acid, or the like. This phrase can also be stated as a "chain terminating moiety comprising an azide," or "chain terminating moiety comprising an azido," or a "chain terminating moiety comprising an azidomethyl" when referring to a subset of the group but may still include the embodiments listed in this paragraph. The phrase "chain terminating moiety comprises an azide, azido or azidomethyl group" is used throughout this disclosure to refer to any of one or more chain terminating moiety features described in this paragraph.

In some embodiments, in the ternary complexes which include nucleotides, the wild type or mutant DNA polymerases may or may not be fluorescently labeled. In some embodiments, the wild type or mutant DNA polymerases comprise fluorescently-labeled DNA polymerases. In some embodiments, the wild type or mutant DNA polymerases lack a fluorophore. In some embodiments, the DNA polymerases comprise fluorescently-labeled DNA polymerases and the nucleotides lack a fluorophore. In some embodiments, the DNA polymerase lacks a fluorophore and the nucleotides comprise fluorescently-labeled nucleotides. In some embodiments, the DNA polymerases comprise fluorescently-labeled DNA polymerases and the nucleotides comprise fluorescently-labeled nucleotides. One or more features described in this paragraph may appear in any example fluorophore molecules in various embodiments described in this disclosure. The features described in this paragraph are referred to as "fluorophore embodiments" throughout this disclosure.

In some embodiments, in the ternary complexes which include nucleotides, the nucleic acid template molecules may take on various forms. For example, the nucleic acid template molecule comprises a linear nucleic acid molecule, or a circular nucleic acid molecule, or a mixture of both linear and circular nucleic acid molecules. In some embodiments, the nucleic acid template molecules comprise a clonally amplified template molecule. In some embodiments, the nucleic acid template molecules comprise one copy of a target sequence of interest. In some embodiments, the nucleic acid template molecules in the plurality of nucleic acid template molecules comprise the same target sequence of interest or different target sequences of interest. In some embodiments, the nucleic acid template molecules comprise two or more tandem copies of a target sequence of interest (e.g., concatemer). In some embodiments, the nucleic acid template molecules include at least one uridine nucleotide or lacks a uridine nucleotide. One or more features described in this paragraph may appear in any nucleic acid templates in various embodiments described in this disclosure. The features described in this paragraph are referred to as "nucleic acid template embodiments" throughout this disclosure.

In some embodiments, in the ternary complexes, which include nucleotides, the plurality of ternary complexes are immobilized. For example, the ternary complexes can be immobilized to a support or immobilized to a coating on the support. In some embodiments, the coating on the support comprises at least one hydrophilic polymer coating layer which comprises branched polyethylene glycol (PEG) having at least 4 branches, and wherein the coating has a water contact angle of no more than 45 degrees. In some embodiments, the support comprises a functionalized polymer coating layer covalently bound at least to a portion of the support via a chemical group on the support, an oligonucleotide primer grafted to the functionalized polymer coating, and a water-soluble protective coating on the primer and the functionalized polymer coating. In some embodiments, the density of the plurality of ternary complexes immobilized to the support is $10^2$-$10^6$ per $mm^2$. In some embodiments, the plurality of ternary complexes are immobilized to predetermined sites on the support. In some embodiments, the plurality of ternary complexes are immobilized to random sites on the support. In some embodiments, the plurality of immobilized ternary complexes are in fluid communication with each other to permit flowing a solution of reagents onto the support so that the plurality of immobilized ternary complexes react with the solution of reagents in a massively parallel manner, and wherein the reagents comprise soluble primers, DNA polymerases, nucleotides, divalent cations and/or a buffer. One or more features described in this paragraph may appear in any example ternary complexes in various embodiments described in this disclosure. The features described in this paragraph are referred to as "immobilization embodiments" throughout this disclosure.

The present disclosure provides a plurality of binding complexes (e.g., a plurality of ternary complexes) each including a multivalent molecule. The plurality of binding complexes or ternary complexes that include multivalent molecules may include any of the same features described above for binding complexes or ternary complexes. In some embodiments, in the ternary complexes which include multivalent molecules may take on various forms. For example, in the ternary complexes which include multivalent molecules, the individual multivalent molecules in the plurality of multivalent molecules may comprise (a) a core; and (b) a plurality of nucleotide arms which comprise (i) a core attachment moiety, (ii) a spacer comprising a PEG moiety, (iii) a linker, and (iv) a nucleotide unit, wherein the core is attached to the plurality of nucleotide arms via their core attachment moiety, wherein the spacer is attached to the linker, and wherein the linker is attached to the nucleotide unit. In some embodiments, the core comprises a streptavidin-type or avidin-type moiety and the core attachment moiety comprises biotin. In some embodiments, the linker comprises an aliphatic chain having 2-6 subunits or an oligo ethylene glycol chain having 2-6 subunits. In some embodiments, the linker further comprises an aromatic moiety. An exemplary spacer is shown in FIG. 16A (top), and exemplary linkers are shown in FIG. 16A (bottom) and 16B. An exemplary nucleotide arm is shown in FIG. 15B. Exemplary multivalent molecules are shown in FIGS. 14A, 14B and 15A. In some embodiments, the nucleotide unit comprises an aromatic base, a five-carbon sugar and 1-10 phosphate groups. In some embodiments, the linker is attached to the nucleotide unit through the base. In some embodiments, the plurality of nucleotide arms attached to the core have the same type of a nucleotide unit, and wherein the types of nucleotide unit is selected from a group consisting of dATP, dGTP, dCTP, dTTP and dUTP. In some embodiments, the plurality of multivalent molecules comprise one type of a multivalent molecule wherein each multivalent molecule in the plurality has the same type of nucleotide unit selected from a group consisting of dATP, dGTP, dCTP, dTTP and dUTP. In some embodiments, the plurality of multivalent molecules comprise a mixture of any combination of two or more types of multivalent molecules each type having nucleotide units selected from a group consisting of dATP, dGTP, dCTP, dTTP and/or dUTP. One or more features described in this paragraph may appear in any example multivalent molecules in various embodiments described in this disclosure. The features described in this paragraph are referred to as “multivalent molecule embodiments” throughout this disclosure.

In some embodiments, in the ternary complexes which include multivalent molecules, the plurality of multivalent molecules comprise fluorescently-labeled multivalent molecules. In some embodiments, the core of individual fluorescently-labeled multivalent molecules is attached to a fluorophore which corresponds to the nucleotide units that are attached to the nucleotide arms in a given multivalent molecule. In some embodiments, at least one of the nucleotide arms of the multivalent molecule comprises a linker and/or nucleotide base that is attached to a fluorophore, and wherein the fluorophore which is attached to a given linker or nucleotide base corresponds to the nucleotide base (e.g., adenine, guanine, cytosine, thymine or uracil) of the nucleotide arm. In some embodiments, multivalent molecule lacks a fluorophore.

In some embodiments, in the ternary complexes which include multivalent molecules, at least one of the multivalent molecules in the plurality of multivalent molecules comprises nucleotide units having a chain terminating moiety, attached to the 3'—OH sugar position via a cleavable moiety, which may include any of the chain terminating moiety embodiments described above. In some embodiments the chain terminating moiety comprises an azide, azido, or azidomethyl group, including any of the potential features listed above.

In some embodiments, in the ternary complexes which include multivalent molecules, the wild type or mutant DNA polymerases may or may not be fluorescently labeled. In some embodiments, the wild type or mutant DNA polymerases may include any of the fluorophore embodiments described above.

In some embodiments, in the ternary complexes which include multivalent molecules, the nucleic acid template molecules may include the nucleic acid template embodiments including any of the potential features listed above.

In some embodiments, in the ternary complexes which include multivalent molecules, which can be immobilized according to the immobilization embodiments, including any of the potential features listed above.

In some embodiments, in the ternary complexes which include multivalent molecules, the plurality of ternary complexes comprises at least a first and second ternary complex with a single multivalent molecule which is bound to the first and second ternary complexes to form a first avidity complex. In some embodiments, the first ternary complex comprises a first DNA polymerase (e.g., a first mutant or wild type DNA polymerase) bound to a first primer hybridized to a first portion of a concatemer template molecule and a first nucleotide unit of the single multivalent molecule is bound to the first primer thereby forming a first ternary complex. In some embodiments, the second ternary complex comprises a second DNA polymerase (e.g., a second mutant or wild type DNA polymerase) bound to a second primer hybridized to a second portion of the same concatemer template molecule and a second nucleotide unit of the single multivalent molecule is bound to the second primer thereby forming a second ternary complex. The first and second ternary complexes which are bound to the multivalent molecule forms the first avidity complex. In some embodiments, the first and/or second ternary complexes remains stable without dissociation for a persistence time of more than 0.1, 0.2, 0.3, 0.4, 0.5, 0.6, 0.7, 0.8, 0.9 or 1 second.

In some embodiments, in the ternary complexes which include multivalent molecules, the first avidity complex further comprises at least a third and fourth ternary complex in which the single multivalent molecule is bound to the first, second, third and fourth ternary complexes. In some embodiments, the third ternary complex comprises a third DNA polymerase (e.g., a third mutant or wild type DNA polymerase) bound to a third primer hybridized to a third portion of the concatemer template molecule and a third nucleotide unit of the single multivalent molecule is bound to the third primer thereby forming a third ternary complex. In some embodiments, the fourth ternary complex comprises a fourth DNA polymerase (e.g., a fourth mutant or wild type DNA polymerase) bound to a fourth primer hybridized to a fourth portion of the same concatemer template molecule and a fourth nucleotide unit of the single multivalent molecule is bound to the fourth primer thereby forming a fourth ternary complex. In some embodiments, the first, second and third ternary complexes which are bound to the multivalent molecule form the first avidity complex. In some embodiments, the first, second, third and fourth ternary complexes which are bound to the multivalent molecule form the first avidity complex. In some embodiments, the third and/or fourth ternary complexes remains stable without dissociation for a persistence time of more than 0.1, 0.2, 0.3, 0.4, 0.5, 0.6, 0.7, 0.8, 0.9 or 1 second.

The present disclosure provides nucleic acid sequencing methods that employ DNA polymerases from Candidatus Altiarchaeales archaeon to form binding complexes (e.g., ternary complexes) which include nucleotides. The present disclosure provides methods for nucleic acid sequencing, comprising: (a) contacting (i) a plurality of wild-type or mutant DNA polymerases, and (ii) a plurality of nucleic acid duplexes each comprising a nucleic acid template molecule hybridized to a nucleic acid primer, wherein the contacting is conducted under a condition suitable to form a plurality of complexed polymerases each comprising the wild-type or mutant DNA polymerase bound to a nucleic acid duplex, wherein the plurality of wild-type DNA polymerases comprise an amino acid sequence that is 100% identical to SEQ ID NO: 1, or wherein the plurality of mutant DNA polymerases comprise an amino acid sequence that is at least 85% identical to SEQ ID NO: 1 (e.g., at least 85% identical to any one of the amino acid sequences of SEQ ID NOS: 2-274 or 288-375 or 385-397); (b) contacting the plurality of complexed polymerases with (iii) a plurality of nucleotides, and (iv) a plurality of a catalytic divalent cations, wherein the contacting is conducted under a condition suitable to form a plurality of ternary complexes each comprising the wild-type or mutant DNA polymerase bound to the nucleic acid duplex and a nucleotide, wherein in the ternary complex the nucleotide is bound to the 3' end of the nucleic acid primer at a position that is opposite a complementary nucleotide in the nucleic acid template molecule, and wherein the condition is suitable to promote polymerase-catalyzed incorporation of the nucleotides bound to the 3' ends of the nucleic acid primers; and (c) detecting the plurality of ternary complexes; and (d) identifying the plurality of incorporated nucleotides in the plurality of ternary complexes. In some embodiments, in individual ternary complexes of step (b), the nucleotide is bound to the nucleic acid duplex and has not undergone polymerase-catalyzed incorporation, or the nucleotide is bound to the nucleic acid duplex and has undergone polymerase-catalyzed incorporation. In some embodiments, the ternary complex remains stable without dissociation (or exhibiting reduced dissociation) of the mutant or wild type polymerase from the nucleic acid duplex, and the stable ternary complex exhibits a persistence time of more than 0.1, 0.2, 0.3, 0.4, 0.5, 0.6, 0.7, 0.8, 0.9 or 1 second. In some embodiments, the catalytic divalent cation comprises magnesium and/or manganese. In some embodiments, the plurality of complexed polymerases comprise nucleic acid template molecules having the same target of interest sequence or different target of interest sequences. In some embodiments, the mutant polymerases include the amino acid substitutions D141A and E143A.

In some embodiments, in the nucleic acid sequencing methods that employ ternary complexes that include nucleotides, the methods comprise: (a) contacting (i) a plurality of wild-type or mutant DNA polymerases, and (ii) a plurality of nucleic acid duplexes each comprising a nucleic acid template molecule hybridized to a nucleic acid primer, wherein the contacting is conducted under a condition suitable to form a plurality of complexed polymerases each comprising the wild-type or mutant DNA polymerase bound to a nucleic acid duplex, wherein the plurality of wild-type DNA polymerases comprise an amino acid sequence that is 100% identical to SEQ ID NO: 1, or wherein the plurality of mutant DNA polymerases comprise an amino acid sequence that is at least 85% identical to SEQ ID NO: 2-274 or 288-375 or 385-397; (b) contacting the plurality of complexed polymerases with (iii) a plurality of nucleotides, and (iv) a plurality of a non-catalytic divalent cations, wherein the contacting is conducted under a condition suitable to form a plurality of ternary complexes each comprising the wild-type or mutant DNA polymerase bound to the nucleic acid duplex and a nucleotide, wherein in the ternary complex the nucleotide is bound to the 3' end of the nucleic acid primer at a position that is opposite a complementary nucleotide in the nucleic acid template molecule, and wherein the condition is suitable to inhibit polymerase-catalyzed incorporation of the nucleotides bound to the 3' ends of the nucleic acid primers; and (c) detecting the plurality of ternary complexes; and (d) identifying the plurality of bound nucleotides in the plurality of ternary complexes. In some embodiments, the non-catalytic divalent cation comprises strontium, barium and/or calcium. In some embodiments, the plurality of complexed polymerases comprise nucleic acid template molecules having the same target of interest sequence or different target of interest sequences. In some embodiments, the mutant polymerases include the amino acid substitutions D141A and E143A.

In some embodiments, in the nucleic acid sequencing methods that employ ternary complexes that may comprise a nucleotide unit. A nucleotide unit may include an aromatic base, a five-carbon sugar (e.g., ribose or deoxyribose), and one or more phosphate groups (e.g., 1-10 phosphate groups), wherein the aromatic base of the nucleotide comprises adenine, guanine, cytosine, thymine or uracil. In some embodiments, the plurality of nucleotides comprises one type of nucleotide selected from a group consisting of dATP, dGTP, dCTP, dTTP and dUTP. In some embodiments, the plurality of nucleotides comprises a mixture of any combination of two or more types of nucleotides selected from a group consisting of dATP, dGTP, dCTP, dTTP and/or dUTP. In some embodiments, at least one of the nucleotides in the plurality of nucleotides is labeled with a fluorophore. In some embodiments, the plurality of nucleotides lack a fluorophore label. One or more features described in this paragraph may appear in any example nucleotide units in various embodiments described in this disclosure. The features described in this paragraph are referred to as "example nucleotide unit features" throughout this disclosure.

In some embodiments, in the nucleic acid sequencing methods that employ ternary complexes that include nucleotides, the plurality of DNA polymerases may or may not be fluorescently labeled, and may include any of the fluorophore embodiments described above. In some embodiments, the plurality of DNA polymerases comprise a plurality of nucleotides.

In some embodiments, in the nucleic acid sequencing methods that employ ternary complexes that include nucleotides, at least one of the nucleotides in the plurality of nucleotides comprises a chain terminating moiety, which may include any of the chain terminating moiety embodiments described above. In some embodiments the chain terminating moiety comprises an azide, azido, or azidomethyl group, including any of the potential features listed above.

In some embodiments, in the nucleic acid sequencing methods that employ ternary complexes that include nucleotides, the plurality of nucleic acid template molecules may include the nucleic acid template embodiments, including any of the potential features listed above.

In some embodiments, in the nucleic acid sequencing methods that employ ternary complexes that include nucleotides, which can be immobilized according to the immobilization embodiments, including any of the potential features listed above.

The present disclosure provides nucleic acid sequencing methods that employ binding complexes (e.g., ternary complexes) which include multivalent molecules. The present disclosure provides methods for nucleic acid sequencing, comprising: (a) contacting (i) a plurality of wild-type or mutant DNA polymerases, and (ii) a plurality of nucleic acid duplexes each comprising a nucleic acid template molecule hybridized to a nucleic acid primer, wherein the contacting is conducted under a condition suitable to form a plurality of complexed polymerases each comprising the mutant DNA polymerase bound to a nucleic acid duplex, wherein the plurality of wild-type DNA polymerases comprise an amino acid sequence that is 100% identical to SEQ ID NO: 1, or wherein the plurality of mutant DNA polymerases comprise an amino acid sequence that is at least 85% identical to SEQ ID NO: 1 (e.g., at least 85% identical to any one of the amino acid sequences of SEQ ID NOS: 2-274 or 288-375 or 385-397); (b) contacting the plurality of complexed polymerases with (iii) a plurality of multivalent molecules, and (iv) a plurality of a non-catalytic divalent cation, wherein the plurality of multivalent molecules each comprise a core attached to a plurality of nucleotide arms, wherein each nucleotide arm comprises a nucleotide unit, wherein the contacting is conducted under a condition suitable to form a plurality of ternary complexes each comprising the mutant DNA polymerase bound to a nucleic acid duplex and a multivalent molecule, wherein in the ternary complex one nucleotide unit of the multivalent molecule is bound to the 3' end of the nucleic acid primer at a position that is opposite a complementary nucleotide in the nucleic acid template molecule, wherein the plurality of ternary complexes remain stable without dissociation for a persistence time of more than 0.1, 0.2, 0.3, 0.4, 0.5, 0.6, 0.7, 0.8, 0.9 or 1 second, and wherein the contacting is conducted under a condition suitable to inhibit polymerase-catalyzed incorporation of the bound nucleotide units of the multivalent molecules; (c) detecting the plurality of ternary complexes; and (d) identifying the plurality of nucleotide units that are bound to the 3' ends of the nucleic acid primers in the plurality of ternary complexes, thereby determining the sequences of the plurality of nucleic acid template molecules. In some embodiments, the mutant polymerases include the amino acid substitutions D141A and E143A.

In yet another example, the mutant polymerases exhibits one or more features of the example mutant polymerase features discussed above. Alternatively or additionally, the mutant polymerases exhibit increased uracil-tolerance (e.g., any of SEQ ID NOS: 361, 362, 363, 364, 366, 367, 374 or 375, or any of SEQ ID NOS: 385-397). In some embodiments, the mutant polymerases include the amino acid substitutions D141A and E143A.

In some embodiments, in the nucleic acid sequencing methods that employ ternary complexes that include multivalent molecules, the ternary complex remains stable without dissociation (or exhibiting reduced dissociation) of the mutant or wild type polymerase from the nucleic acid duplex, and the stable ternary complex exhibits a persistence time of more than 0.1, 0.2, 0.3, 0.4, 0.5, 0.6, 0.7, 0.8, 0.9 or 1 second. In some embodiments, the plurality of non-catalytic divalent cations comprise strontium, barium and/or calcium. In some embodiments, the plurality of complexed polymerases comprise nucleic acid template molecules having the same target of interest sequence or different target of interest sequences.

In some embodiments, in the nucleic acid sequencing methods that employ ternary complexes that include multivalent molecules, in the ternary complex, the nucleotide unit of the multivalent molecule is bound to the nucleic acid duplex and has not undergone polymerase-catalyzed incorporation, or the nucleotide unit is bound to the nucleic acid duplex and has undergone polymerase-catalyzed incorporation.

In some embodiments, in the nucleic acid sequencing methods that employ ternary complexes that include multivalent molecules, the method further comprises forming an avidity complex, comprising the steps: (1) contacting the plurality of wild type or mutant DNA polymerases and the plurality of nucleic acid primers with different portions of a concatemer nucleic acid template molecule to form at least first and second complexed polymerases on the same concatemer template molecule; (2) contacting a plurality of multivalent molecules to the at least first and second complexed polymerases on the same concatemer template molecule, under conditions suitable to bind a single multivalent molecule from the plurality to the first and second complexed polymerases, wherein at least a first nucleotide unit of the single multivalent molecule is bound to the first complexed polymerase which includes a first primer hybridized to a first portion of the concatemer template molecule thereby forming a first ternary complex, and wherein at least a second nucleotide unit of the single multivalent molecule is bound to the second complexed polymerase which includes a second primer hybridized to a second portion of the concatemer template molecule thereby forming a second ternary complex, and wherein the contacting is conducted under a condition suitable to inhibit polymerase-catalyzed incorporation of the bound first and second nucleotide units in the first and second ternary complexes, and wherein the first and second ternary complexes which are bound to the same multivalent molecule forms an avidity complex; and (3) detecting the first and second ternary complexes on the same concatemer template molecule; and (4) identifying the first nucleotide unit in the first ternary complex thereby determining the sequence of the first portion of the concatemer template molecule, and identifying the second nucleotide unit in the second ternary complex thereby determining the sequence of the second portion of the concatemer template molecule. In some embodiments, in the methods for forming an avidity complex, the identifying of step (4) comprises: identifying the first nucleotide unit that is bound to the 3' end of the first primer in the first ternary complex thereby determining the sequence of the first portion of the concatemer template molecule, and identifying the second nucleotide unit that is bound to the 3' end of the second primer in the second ternary complex thereby determining the sequence of the second portion of the concatemer template molecule.

In some embodiments, in the nucleic acid sequencing methods that employ ternary complexes that include multivalent molecules, the multivalent molecules may include any of the multivalent molecule embodiments, including any of the potential features listed above.

In some embodiments, in the nucleic acid sequencing methods that employ ternary complexes that include multivalent molecules, which may or may not be fluorescently labeled, and may include any of the fluorophore embodiments described above. In some embodiments, the core of individual multivalent molecules is attached to nucleotide units that are attached to the nucleotide arms, may or may not be fluorescently labeled, and may include any of the fluorophore embodiments described above. In some embodiments, at least one of the nucleotide arms of the multivalent molecule comprises a linker and/or nucleotide base that is attached to a fluorophore, and wherein the fluorophore which is attached to a given linker or nucleotide base corresponds to the nucleotide base (e.g., adenine, guanine, cytosine, thymine or uracil) of the nucleotide arm.

In some embodiments, in the nucleic acid sequencing methods that employ ternary complexes that include multivalent molecules, at least one of the multivalent molecules in the plurality of multivalent molecules comprises nucleotide units having a chain terminating moiety attached to the 3'—OH sugar position via a cleavable moiety, which may include any of the chain terminating moiety embodiments described above. In some embodiments the chain terminating moiety comprises an azide, azido, or azidomethyl group, including any of the potential features listed above.

In some embodiments, in the nucleic acid sequencing methods that employ ternary complexes that include multivalent molecules, the plurality of DNA polymerases comprise fluorescently-labeled DNA polymerases. In some embodiments, the plurality of DNA polymerases lack a fluorophore.

In some embodiments, in the nucleic acid sequencing methods that employ ternary complexes that include multivalent molecules, the plurality of nucleic acid template molecules may include the nucleic acid template embodiments, including any of the potential features listed above.

In some embodiments, in the nucleic acid sequencing methods that employ ternary complexes that include multivalent molecules, which can be immobilized according to the immobilization embodiments, including any of the potential features listed above.

The present disclosure provides two-phase nucleic acid sequencing methods that employ polymerases from Candidatus Altiarchaeales archaeon, multivalent molecules and nucleotides. The present disclosure provides methods for nucleic acid sequencing, comprising: (a) contacting (i) a plurality of a first wild-type or mutant DNA polymerase, and (ii) a plurality of nucleic acid duplexes each comprising a nucleic acid template molecule hybridized to a nucleic acid primer, wherein the contacting is conducted under a condition suitable to form a plurality of first complexed polymerases each comprising the first wild-type or mutant DNA polymerase bound to the nucleic acid duplex, wherein the plurality of the first wild-type DNA polymerase comprises an amino acid sequence that is 100% identical to SEQ ID NO: 1, or wherein the plurality of the first mutant DNA polymerase comprises an amino acid sequence that is at least 85% identical to SEQ ID NO: 1 (e.g., at least 85% identical to any one of the amino acid sequences of SEQ ID NOS: 2-274 or 288-375 or 385-397); (b) contacting the plurality of first complexed polymerases with (iii) a plurality of multivalent molecules, and (iv) a plurality of non-catalytic divalent cations, wherein the plurality of multivalent molecules each comprises a core attached to a plurality of nucleotide arms and wherein each nucleotide arm comprises a nucleotide unit, wherein the contacting is conducted under a condition suitable to form a plurality of first ternary complexes each comprising the first wild-type or mutant DNA polymerase bound to the nucleic acid duplex and a multivalent molecule, wherein in the first ternary complex, a nucleotide unit of the multivalent molecule is bound to the 3' end of the nucleic acid primer at a position that is opposite a complementary nucleotide in the nucleic acid template molecule, and wherein the contacting is conducted under a condition suitable to inhibit polymerase-catalyzed incorporation of the bound nucleotide units of the multivalent molecules; (c) detecting the plurality of first ternary complexes and identifying the nucleotide units that are bound to the 3' ends of the nucleic acid primers thereby determining the sequences of the nucleic acid template molecules; (d) dissociating the plurality of first ternary complexes by removing the plurality of the first wild-type or mutant polymerases and the plurality of multivalent molecules, and retaining the plurality of nucleic acid duplexes; (e) contacting the retained nucleic acid duplexes of step (d) with (i) a plurality of a second wild-type or mutant DNA polymerase, (ii) a plurality of nucleotides, and (iii) a plurality of catalytic divalent cations, wherein the plurality of the second wild-type DNA polymerase comprises an amino acid sequence that is 100% identical to SEQ ID NO: 1, or wherein the plurality of the second mutant DNA polymerase comprises an amino acid sequence that is at least 85% identical to SEQ ID NO: 1 (e.g., at least 85% identical to any one of the amino acid sequences of SEQ ID NOS: 2-274 or 288-375 or 385-397), wherein the contacting of step (e) is conducted under a condition suitable to form a plurality of second ternary complexes each comprising the second wild-type or mutant DNA polymerase bound to the retained nucleic acid duplex of step (d) and the nucleotide, wherein in the second ternary complex the nucleotide is bound to the 3' end of the nucleic acid primer at a position that is opposite a complementary nucleotide in the nucleic acid template molecule, and wherein the condition is suitable to promote polymerase-catalyzed incorporation of the nucleotides bound to the 3' ends of the nucleic acid primers; and (f) detecting the plurality of second ternary complexes and identifying the incorporated nucleotides in the second ternary complexes. In some embodiments, the detecting of step (f) is optional. In some embodiments, the identifying of step (f) is optional. In some embodiments, the mutant polymerases include the amino acid substitutions D141A and E143A.

In some embodiments, the two-phase nucleic acid sequencing methods that employ polymerases from Candidatus Altiarchaeales archaeon, in the first ternary complex, the nucleotide unit of the multivalent molecule is bound to the nucleic acid duplex and has not undergone polymerase-catalyzed incorporation, or the nucleotide unit is bound to the nucleic acid duplex and has undergone polymerase-catalyzed incorporation. In some embodiments, in the second ternary complex, the nucleotide is bound to the nucleic acid duplex and has not undergone polymerase-catalyzed incorporation, or the nucleotide is bound to the nucleic acid duplex and has undergone polymerase-catalyzed incorporation.

In some embodiments, the two-phase nucleic acid sequencing methods that employ polymerases from Candidatus Altiarchaeales archaeon, the first mutant DNA polymerase comprises one or more features listed above in connection to example mutant polymerase features. In yet another example, the first mutant polymerases exhibit increased uracil-tolerance (e.g., any of SEQ ID NOS: 361, 362, 363, 364, 366, 367, 374 or 375, or any of SEQ ID NOS: 385-397).

In some embodiments, the first wild type or mutant DNA polymerase comprises a fluorescently-labeled DNA polymerase. In some embodiments, first wild type or mutant DNA polymerase lacks a fluorophore.

In some embodiments, the two-phase nucleic acid sequencing methods that employ polymerases from Candidatus Altiarchaeales archaeon, the second mutant DNA polymerase include one or more features listed above in connection to example mutant polymerase features. In yet another example, the second mutant polymerases exhibit increased uracil-tolerance (e.g., any of SEQ ID NOS: 361, 362, 363, 364, 366, 367, 374 or 375, or any of SEQ ID NOS: 385-397).

In some embodiments, the second wild type or mutant DNA polymerase comprises a fluorescently-labeled DNA polymerase. In some embodiments, the second mutant DNA polymerase lacks a fluorophore.

In some embodiments, the two-phase nucleic acid sequencing methods that employ polymerases from Candidatus Altiarchaeales archaeon, the plurality of non-catalytic divalent cations in step (b) comprise strontium, barium and/or calcium. In some embodiments, the plurality of catalytic divalent cations in step (e) comprise magnesium and/or manganese. In some embodiments, the plurality of the first ternary complexes in step (b) remain stable without dissociation (or exhibiting reduced dissociation) of the mutant or wild type polymerases from the nucleic acid duplexes, and the stable ternary complexes exhibit a persistence time of more than 0.1, 0.2, 0.3, 0.4, 0.5, 0.6, 0.7, 0.8, 0.9 or 1 second. In some embodiments, the plurality of the second ternary complexes in step (e) remain stable without dissociation (or exhibiting reduced dissociation) of the mutant or wild type polymerases from the nucleic acid duplexes, and the stable ternary complexes exhibit a persistence time of more than 0.1, 0.2, 0.3, 0.4, 0.5, 0.6, 0.7, 0.8, 0.9 or 1 second.

In some embodiments, the two-phase nucleic acid sequencing methods that employ polymerases from Candidatus Altiarchaeales archaeon further comprise: (g) removing the plurality of the second wild-type or mutant DNA polymerases and retaining the plurality of nucleic acid duplexes of step (f); (h) contacting the retained nucleic acid duplex of step (g) with a plurality of the first wild-type or mutant DNA polymerase, a plurality of multivalent molecules, and a plurality of non-catalytic divalent cations, wherein the contacting is conducted under a condition suitable to form another plurality of the first ternary complexes, and wherein the contacting is conducted under a condition suitable to inhibit polymerase-catalyzed incorporation of the bound nucleotide units of the multivalent molecules; (i) detecting the plurality of the first ternary complexes formed in step (h) and identifying the nucleotide units that are bound to the 3' ends of the nucleic acid primers, thereby determining the sequences of the nucleic acid template molecules; (j) dissociating the plurality of the first ternary complexes formed in step (h) by removing the plurality of the first wild-type or mutant polymerases and the plurality of the multivalent molecules, and retaining the plurality of the nucleic acid duplexes; (k) contacting the plurality of the retained nucleic acid duplexes of step (j) with a plurality of the second wild-type or mutant DNA polymerase, a plurality of nucleotides, and a plurality of catalytic divalent cations, wherein the contacting is conducted under a condition suitable to form another plurality of the second ternary complexes, and wherein the condition is suitable to promote polymerase-catalyzed incorporation of the nucleotides bound to the 3' ends of the nucleic acid primers; (l) detecting the plurality of the second ternary complex formed in step (k) and identifying the plurality of incorporated nucleotides in the second ternary complexes; and (m) repeating steps (g)-(l) at least once. In some embodiments, the detecting of step (l) is optional. In some embodiments, the identifying of step (l) is optional. In some embodiments, the plurality of the first ternary complexes in step (h) remain stable without dissociation (or exhibiting reduced dissociation) of the mutant or wild type polymerases from the nucleic acid duplexes, and the stable ternary complexes exhibit a persistence time of more than 0.1, 0.2, 0.3, 0.4, 0.5, 0.6, 0.7, 0.8, 0.9 or 1 second. In some embodiments, the plurality of the second ternary complexes in step (k) remain stable without dissociation (or exhibiting reduced dissociation) of the mutant or wild type polymerases from the nucleic acid duplexes, and the stable ternary complexes exhibit a persistence time of more than 0.1, 0.2, 0.3, 0.4, 0.5, 0.6, 0.7, 0.8, 0.9 or 1 second.

In some embodiments, in the two-phase nucleic acid sequencing methods that employ polymerases from Candidatus Altiarchaeales archaeon, the non-catalytic divalent cation comprises strontium, barium and/or calcium, and the catalytic divalent cation comprises magnesium or manganese.

In some embodiments, the two-phase nucleic acid sequencing methods that employ polymerases from Candidatus Altiarchaeales archaeon further comprise forming an avidity complex, comprising the steps: (1) contacting the plurality of wild type or mutant DNA polymerases and the plurality of nucleic acid primers with different portions of a concatemer nucleic acid template molecule to form at least first and second complexed polymerases on the same concatemer template molecule; (2) contacting a plurality of multivalent molecules to the at least first and second complexed polymerases on the same concatemer template molecule, under conditions suitable to bind a single multivalent molecule from the plurality to the first and second complexed polymerases, wherein at least a first nucleotide unit of the single multivalent molecule is bound to the first complexed polymerase which includes a first primer hybridized to a first portion of the concatemer template molecule thereby forming a first concatemer-ternary complex, and wherein at least a second nucleotide unit of the single multivalent molecule is bound to the second complexed polymerase which includes a second primer hybridized to a second portion of the concatemer template molecule thereby forming a second concatemer-ternary complex, and wherein the contacting is conducted under a condition suitable to inhibit polymerase-catalyzed incorporation of the bound first and second nucleotide units in the first and second concatemer-ternary complexes, and wherein the first and second concatemer-ternary complexes which are bound to the same multivalent molecule form an avidity complex; (3) detecting the first and second concatemer-ternary complexes on the same concatemer template molecule; and (4) identifying the first nucleotide unit in the first concatemer-ternary complex thereby determining the sequence of the first portion of the concatemer template molecule, and identifying the second nucleotide unit in the second concatemer-ternary complex thereby determining the sequence of the second portion of the concatemer template molecule. In some embodiments, the identifying of step (4) comprises: identifying the first nucleotide unit that is bound to the 3' end of the first primer in the first concatemer-ternary complex thereby determining the sequence of the first portion of the concatemer template molecule, and identifying the second nucleotide unit that is bound to the 3' end of the second primer in the second concatemer-ternary complex thereby determining the sequence of the second portion of the concatemer template molecule.

In some embodiments, in the two-phase nucleic acid sequencing methods that employ polymerases from Candidatus Altiarchaeales archaeon, there may be multivalent molecules that may include any of the multivalent molecule embodiments, including any of the potential features listed above. any of the potential features.

In some embodiments, in the two-phase nucleic acid sequencing methods that employ polymerases from Candidatus Altiarchaeales archaeon, the multivalent molecule lacks a fluorophore. In some embodiments, the multivalent molecule is labeled with a fluorophore. In some embodiments, the plurality of multivalent molecules of step (b) are fluorescently-labeled multivalent molecules, and step (c) comprises detecting a fluorescent signal from the plurality of first ternary complexes and identifying the nucleotide units that are bound to the 3' ends of the nucleic acid primers thereby determining the sequences of the nucleic acid template molecules.

In some embodiments, in the two-phase nucleic acid sequencing methods that employ polymerases from Candidatus Altiarchaeales archaeon, at least one of the nucleotide units of the multivalent molecule comprises a chain terminating moiety attached to the 3'—OH sugar position via a cleavable moiety, which may include any of the chain terminating moiety embodiments described above. In some embodiments the chain terminating moiety comprises an azide, azido, or azidomethyl group, including any of the potential features listed above. In some embodiments, in the two-phase nucleic acid sequencing methods that employ polymerases from Candidatus Altiarchaeales archaeon, the nucleotide of steps (e) and/or (k) comprises a nucleotide unit that includes one or more example nucleotide unit features as discussed above. In some embodiments, the plurality of nucleotides of step (e) lacks a fluorophore. In some embodiments, at least one of the nucleotides of the plurality of the nucleotide of step (e) is labeled with a fluorophore.

In some embodiments, in the two-phase nucleic acid sequencing methods that employ polymerases from Candidatus Altiarchaeales archaeon, the plurality of nucleotides of steps (e) and/or (k) comprises a chain terminating moiety attached to the 3'—OH sugar position via a cleavable moiety, which may include any of the chain terminating moiety embodiments described above. In some embodiments the chain terminating moiety comprises an azide, azido, or azidomethyl group, including any of the potential features listed above.

In some embodiments, in the two-phase nucleic acid sequencing methods that employ polymerases from Candidatus Altiarchaeales archaeon, the plurality of nucleotides in step (e) comprise a chain terminating moiety attached to the 3'—OH sugar position via a cleavable moiety, and step (f) further comprises contacting the chain terminating nucleotides incorporated into the nucleic acid primers with a cleaving agent to remove the chain terminating moieties thereby generating a plurality of nucleic acid primers having 3' extendible ends.

In some embodiments, in the two-phase nucleic acid sequencing methods that employ polymerases from Candidatus Altiarchaeales archaeon, the plurality of the second wild-type or mutant DNA polymerase may or may not be fluorescently labeled, and may include any of the fluorophore embodiments described above. In some embodiments, the plurality of the second wild-type or mutant DNA polymerases comprise a plurality of nucleotides, which may or may not be fluorescently labeled, and may include any of the fluorophore embodiments described above.

In some embodiments, in the two-phase nucleic acid sequencing methods that employ polymerases from Candidatus Altiarchaeales archaeon include a nucleic acid template molecule may include the nucleic acid template embodiments, including any of the potential features listed above.

In some embodiments, in the two-phase nucleic acid sequencing methods that employ polymerases from Candidatus Altiarchaeales archaeon, the plurality of first complexed polymerases are immobilized according to the immobilization embodiments, including any of the potential features listed above.

The present disclosure provides recombinant mutant 9° N DNA polymerases. A "recombinant mutant 9° N DNA," as used within this specification, may include any of the features described in this, and the following, paragraphs. For example the recombinant mutant 9° N DNA may comprise: a backbone amino acid sequence of SEQ ID NO: 280 or 281 or 282 and have at least one or any combination of two or more amino acid substitution mutations including: (1) leucine (L) at position 408 is substituted with serine (S), phenylalanine (F), tyrosine (Y), valine (V), glycine (G), threonine (T), alanine (A), isoleucine (I), phenylalanine (F) or methionine (M); (2) tyrosine (Y) at position 409 is substituted with alanine (A), threonine (T), serine (S), glycine (G), valine (V), isoleucine (I) or tyrosine (Y); (3) proline (P) at position 410 is substituted with glycine (G), serine (S), valine (V), cysteine (C), lysine (K), isoleucine (I), threonine (T) or alanine (A); (4) alanine (A) at position 485 is substituted with serine (S) or valine (V); (5) serine (S) at position 492 is substituted with glycine (G); (6) lysine (K) at position 507 is substituted with leucine (L), tryptophan (W), tyrosine (Y), proline (P) or phenylalanine (F); (7) isoleucine at position 521 is substituted with histidine (H), threonine (T), valine (V), serine (S), glycine (G), alanine (A), leucine (L) or phenylalanine (F); and/or (8) lysine (K) at position 559 is substituted with aspartic acid (D). In some embodiments, the mutant 9° N DNA polymerases further comprise the amino acid substitutions D141A and E143A.

In some embodiments, the recombinant mutant 9° N DNA polymerases comprise: a backbone amino acid sequence of SEQ ID NO: 280 or 281 or 282 and having the combination of amino acid substitution mutations including: (i) leucine (L) at position 408 is substituted with serine (S), phenylalanine (F) or tyrosine (Y); and (ii) tyrosine (Y) at position 409 is substituted with alanine (A), proline (P) at position 410 is substituted with glycine (G), alanine (A) at position 485 is substituted with serine (S), lysine (K) at position 507 is substituted with leucine (L), isoleucine at position 521 is substituted with histidine (H), and lysine (K) at position 559 is substituted with aspartic acid (D). A mutant 9° N DNA polymerase based on the backbone sequence of SEQ ID NO: 280 and having substitution mutations L408S, Y409A, P418G, A485S, K507L, I521H and K559D (SEQ ID NO: 376). A mutant 9° N DNA polymerase based on the backbone sequence of SEQ ID NO: 281 and having substitution mutations L408S, Y409A, P418G, A485S, K507L, I521H and K559D (SEQ ID NO: 379). A mutant 9° N DNA polymerase based on the backbone sequence of SEQ ID NO: 282 and having substitution mutations L408S, Y409A, P418G, A485S, K507L, I521H and K559D (SEQ ID NO: 382). A mutant 9° N DNA polymerase based on the backbone sequence of SEQ ID NO: 280 and having substitution mutations L408F, Y409A, P418G, A485S, K507L, I521H and K559D (SEQ ID NO: 377). A mutant 9° N DNA polymerase based on the backbone sequence of SEQ ID NO: 281 and having substitution mutations L408F, Y409A, P418G, A485S, K507L, I521H and K559D (SEQ ID NO: 380). A mutant 9° N DNA polymerase based on the backbone sequence of SEQ ID NO: 282 and having substitution mutations L408F, Y409A, P418G, A485S, K507L, I521H and K559D (SEQ ID NO: 383). In some embodiments, the mutant 9° N DNA polymerases further comprise the amino acid substitutions D141A and E143A.

In some embodiments, the recombinant mutant 9° N DNA polymerases comprise: a backbone amino acid sequence of SEQ ID NO: 280 or 281 or 282 and having the combination of amino acid substitution mutations including: (i) leucine (L) at position 408 is substituted with serine (S), phenylalanine (F) or tyrosine (Y); and (ii) tyrosine (Y) at position 409 is substituted with alanine (A), proline (P) at position 410 is substituted with glycine (G), alanine (A) at position 485 is substituted with serine (S), serine (S) at position 492 is substituted with glycine (G), lysine (K) at position 507 is substituted with leucine (L), isoleucine at position 521 is substituted with histidine (H), and lysine (K) at position 559 is substituted with aspartic acid (D). A mutant 9° N DNA polymerase based on the backbone sequence of SEQ ID NO: 280 and having substitution mutations L408F, Y409A, P418G, A485S, S492G, K507L, I521H and K559D (SEQ ID NO: 378). A mutant 9° N DNA polymerase based on the backbone sequence of SEQ ID NO: 281 and having substitution mutations L408F, Y409A, P418G, A485S, S492G, K507L, I521H and K559D (SEQ ID NO: 381). A mutant 9° N DNA polymerase based on the backbone sequence of SEQ ID NO: 282 and having substitution mutations L408F, Y409A, P418G, A485S, S492G, K507L, I521H and K559D (SEQ ID NO: 384). In some embodiments, the mutant 9° N DNA polymerases further comprise the amino acid substitutions D141A and E143A.

In some embodiments, the recombinant mutant 9° N DNA polymerases further comprise: a nucleic acid template molecule; and a nucleotide polymerization initiation site having a 3' extendible end. The nucleic acid template molecule may include any of the nucleic acid template embodiments, including any of the potential features listed above.

In some embodiments, the recombinant mutant 9° N DNA polymerases further comprise: a nucleic acid template molecule; and a nucleotide polymerization initiation site having a 3' extendible end; and at least one nucleotide, wherein the at least one nucleotide comprises a nucleotide unit that includes one or more example nucleotide unit features as discussed above.

In some embodiments, the recombinant mutant 9° N DNA polymerase is part of a ternary complex which comprises: the recombinant mutant 9° N DNA polymerase, which is bound to the nucleic acid template molecule, which is hybridized to the nucleic acid primer, and at least one nucleotide which is bound to the 3' end of the nucleic acid primer at a position that is opposite a complementary nucleotide in the nucleic acid template molecule. In some embodiments, in the ternary complex, the nucleotide is bound to the nucleic acid duplex and has not undergone polymerase-catalyzed incorporation, or the nucleotide is bound to the nucleic acid duplex and has undergone polymerase-catalyzed incorporation.

In some embodiments, the recombinant mutant 9° N DNA polymerases further comprise: a nucleic acid template molecule; and a nucleotide polymerization initiation site having a 3' extendible end; and at least one nucleotide which is labeled with a fluorophore or the at least one nucleotide lacks a fluorophore label.

In some embodiments, the recombinant mutant 9° N DNA polymerases further comprise: a nucleic acid template molecule; and a nucleotide polymerization initiation site having a 3' extendible end; and at least one nucleotide which comprises a chain terminating moiety attached to the 3'—OH sugar position via a cleavable moiety, which may include any of the chain terminating moiety embodiments described above. In some embodiments the chain terminating moiety comprises an azide, azido, or azidomethyl group, including any of the potential features listed above.

In some embodiments, the recombinant mutant 9° N DNA polymerases comprise recombinant mutant 9° N DNA polymerases that may or may not be fluorescently labeled and may include any of the fluorophore embodiments described above. In some embodiments, the recombinant mutant 9° N DNA polymerase comprises at least one nucleotide, which may, or may not, be fluorescently labeled.

In some embodiments, the recombinant mutant 9° N DNA polymerases further comprise at least one multivalent molecule, which may include any of the multivalent molecule embodiments, including any of the potential features listed above.

In some embodiments, the recombinant mutant 9° N DNA polymerases further comprise at least one multivalent molecule, which may, or may not, be fluorescently labeled as described above. which includes at least one fluorescently-labeled multivalent molecule. In some embodiments, the at least one multivalent molecule comprises a core that is labeled with a fluorophore. In some embodiments, the at least one multivalent molecule comprises one or more nucleotide arms having a linker and/or a nucleotide unit that is attached to a fluorophore. In some embodiments, the recombinant mutant 9° N DNA polymerases further comprise multivalent molecules which lack a fluorophore.

In some embodiments, the recombinant mutant 9° N DNA polymerases further comprise at least one multivalent molecule which includes nucleotide units having a chain terminating moiety attached to the 3'—OH sugar position via a cleavable moiety, which may include any of the chain terminating moiety embodiments described above. In some embodiments the chain terminating moiety comprises an azide, azido, or azidomethyl group, including any of the potential features listed above.

In some embodiments, the recombinant mutant 9° N DNA polymerase comprises a polymerase that may or may not be fluorescently labeled, and may include any of the fluorophore embodiments described above. In some embodiments, the recombinant mutant 9° N DNA polymerase comprises a polymerase and further comprises at least one multivalent molecule that may or may not be fluorescently labeled, and may include any of the fluorophore embodiments described above.

In some embodiments, the recombinant mutant 9° N DNA polymerases further comprise: a nucleic acid template molecule; and a nucleotide polymerization initiation site having a 3' extendible end; and a plurality of catalytic divalent cations that promote polymerase-catalyzed nucleotide incorporation, wherein the catalytic divalent cations comprise magnesium and/or manganese.

In some embodiments, the recombinant mutant 9° N DNA polymerases further comprise: a nucleic acid template molecule; and a nucleotide polymerization initiation site having a 3' extendible end; and a plurality of non-catalytic divalent cations that inhibit polymerase-catalyzed nucleotide incorporation, wherein the non-catalytic divalent cations comprise strontium, barium and/or calcium.

In some embodiments, the recombinant mutant 9° N DNA polymerases further comprise: a plurality of mutant DNA polymerases bound to a plurality of nucleic acid template molecules and a plurality of nucleotide polymerization initiation sites, which form a plurality of complexed mutant DNA polymerases each comprising a mutant DNA polymerase bound to a nucleic acid duplex where the duplex comprises a nucleic acid template molecule hybridized to an oligonucleotide primer. In some embodiments, the plurality of complexed mutant DNA polymerases are immobilized according to the immobilization embodiments, including any of the potential features listed above.

The present disclosure provides nucleic acid sequencing methods that employ mutant 9° N DNA polymerases and nucleotides. The present disclosure provides nucleic acid sequencing methods, comprising: (a) contacting (i) a plurality of mutant 9° N DNA polymerases, and (ii) a plurality of nucleic acid duplexes each comprising a nucleic acid template molecule hybridized to a nucleic acid primer, wherein the contacting is conducted under a condition suitable to form a plurality of complexed polymerases each comprising the mutant 9° N DNA polymerase bound to a nucleic acid duplex; (b) contacting the plurality of complexed polymerases with (iii) a plurality of nucleotides, and (iv) a plurality of catalytic or non-catalytic divalent cations, wherein the contacting is conducted under a condition suitable to form a plurality of ternary complexes each comprising the mutant DNA polymerase bound to the nucleic acid duplex and a nucleotide, wherein in the ternary complex the nucleotide is bound to the 3' end of the nucleic acid primer at a position that is opposite a complementary nucleotide in the nucleic acid template molecule, and wherein the condition is suitable to promote polymerase-catalyzed incorporation of the nucleotides bound to the 3' ends of the nucleic acid primers, or the condition is suitable to inhibit polymerase-catalyzed incorporation of the nucleotides bound to the 3' ends of the nucleic acid primers; and (c) detecting the plurality of ternary complexes; and (d) identifying the plurality of incorporated nucleotides in the plurality of ternary complexes. The description of the mutant polymerases described earlier (e.g., paragraphs above about mutant 9° N DNA polymerases) also applies here.

In some embodiments, in the sequencing methods that employ mutant 9° N DNA polymerases and nucleotides, the plurality of the ternary complex remains stable without dissociation (or exhibiting reduced dissociation) of the mutant or wild type polymerase from the nucleic acid duplex, and the stable ternary complex exhibits a persistence time of more than 0.1, 0.2, 0.3, 0.4, 0.5, 0.6, 0.7, 0.8, 0.9 or 1 second.

In some embodiments, in the sequencing methods that employ mutant 9° N DNA polymerases and nucleotides, the nucleotides are bound to the nucleic acid duplexes and have not undergone polymerase-catalyzed incorporation, or the nucleotides are bound to the nucleic acid duplexes and have undergone polymerase-catalyzed incorporation.

In some embodiments, in the sequencing methods that employ mutant 9° N DNA polymerases and nucleotides, the plurality of catalytic divalent cations comprises magnesium and/or manganese. In some embodiments, in the sequencing methods that employ mutant 9° N DNA polymerases and nucleotides, the plurality of non-catalytic divalent cations comprises strontium, barium and/or calcium.

In some embodiments, in the sequencing methods that employ mutant 9° N DNA polymerases and nucleotides, the plurality of mutant 9° N DNA polymerases comprises a plurality of fluorescently-labeled polymerases, or the plurality of mutant 9° N DNA polymerases lack a fluorophore.

In some embodiments, in the sequencing methods that employ mutant 9° N DNA polymerases and nucleotides, individual nucleotides in the plurality of nucleotides comprise a nucleotide unit that includes one or more example nucleotide unit features as discussed above.

In some embodiments, in the sequencing methods that employ mutant 9° N DNA polymerases and nucleotides, these may or may not be fluorescently labeled, and may include any of the fluorophore embodiments described above.

In some embodiments, in the sequencing methods that employ mutant 9° N DNA polymerases and nucleotides, at least one of the nucleotides in the plurality of nucleotides comprises a chain terminating moiety attached to 3'—OH sugar position via cleavable moiety, which may include any of the chain terminating moiety embodiments described above. In some embodiments the chain terminating moiety comprises an azide, azido, or azidomethyl group, including any of the potential features listed above.

In some embodiments, in the sequencing methods that employ mutant 9° N DNA polymerases and nucleotides, the plurality of nucleic acid template molecules may include the nucleic acid template embodiments, including any of the potential features listed above.

In some embodiments, in the sequencing methods that employ mutant 9° N DNA polymerases and nucleotides, the plurality of complexed polymerases are immobilized according to the immobilization embodiments, including any of the potential features listed above The present disclosure provides nucleic acid sequencing methods that employ mutant 9° N DNA polymerases and a multivalent molecule, each of which has been described earlier, which descriptions also apply here.

In some embodiments, in the sequencing methods that employ mutant 9° N DNA polymerases and multivalent molecules, the plurality of the ternary complex remains stable without dissociation (or exhibiting reduced dissociation) of the mutant or wild type polymerase from the nucleic acid duplex, and the stable ternary complex exhibits a persistence time of more than 0.1, 0.2, 0.3, 0.4, 0.5, 0.6, 0.7, 0.8, 0.9 or 1 second.

In some embodiments, in the sequencing methods that employ mutant 9° N DNA polymerases and multivalent molecules, in the ternary complex, the nucleotide unit of the multivalent molecule is bound to the nucleic acid duplex and has not undergone polymerase-catalyzed incorporation, or the nucleotide unit is bound to the nucleic acid duplex and has undergone polymerase-catalyzed incorporation.

In some embodiments, in the sequencing methods that employ mutant 9° N DNA polymerases and multivalent molecules further comprise forming an avidity complex, the methods for forming an avidity complex involved steps similar to those that were described earlier for the two-phase nucleic acid sequencing methods that employ polymerases from Candidatus Altiarchaeales (steps (1)-(4)) further comprise forming an avidity complex, the steps comprising: (a) contacting the plurality of mutant 9° N DNA polymerases and the plurality of nucleic acid primers with different portions of a concatemer nucleic acid template molecule to form at least first and second complexed polymerases on the same concatemer template molecule; (b) contacting the plurality of multivalent molecules to the at least first and second complexed polymerases on the same concatemer template molecule, under conditions suitable to bind a single multivalent molecule from the plurality to the first and second complexed polymerases, wherein at least a first nucleotide unit of the single multivalent molecule is bound to the first complexed polymerase which includes a first primer hybridized to a first portion of the concatemer template molecule thereby forming a first ternary complex, and wherein at least a second nucleotide unit of the single multivalent molecule is bound to the second complexed polymerase which includes a second primer hybridized to a second portion of the concatemer template molecule thereby forming a second ternary complex, wherein the contacting is conducted under a condition suitable to inhibit polymerase-catalyzed incorporation of the bound first and second nucleotide units in the first and second ternary complexes (respectively), and wherein the first and second ternary complexes which are bound to the same multivalent molecule forms an avidity complex; and (c) detecting the first and second ternary complexes on the same concatemer template molecule; and (d) identifying the first nucleotide unit in the first ternary complex thereby determining the sequence of the first portion of the concatemer template molecule, and identifying the second nucleotide unit in the second ternary complex thereby determining the sequence of the second portion of the concatemer template molecule. In some embodiments, the identifying of step (d) comprises: identifying the first nucleotide unit that is bound to the 3' end of the first primer in the first ternary complex thereby determining the sequence of the first portion of the concatemer template molecule, and identifying the second nucleotide unit that is bound to the 3' end of the second primer in the second ternary complex thereby determining the sequence of the second portion of the concatemer template molecule.

In some embodiments, in the sequencing methods that employ mutant 9° N DNA polymerases and multivalent molecules, the non-catalytic divalent cation comprises strontium, barium and/or calcium.

In some embodiments, in the sequencing methods that employ mutant 9° N DNA polymerases and multivalent molecules, individual multivalent molecules may include any of the multivalent molecule embodiments, including any of the potential features listed above.

In some embodiments, in the sequencing methods that employ mutant 9° N DNA polymerases and multivalent molecules, the plurality of multivalent molecules may or may not be fluorescently labeled, and may include any of the fluorophore embodiments described above.

In some embodiments, in the sequencing methods that employ mutant 9° N DNA polymerases and multivalent molecules, at least one of the multivalent molecules in the plurality of multivalent molecules comprises nucleotide units having a chain terminating moiety attached to the 3'—OH sugar position via a cleavable moiety, which may include any of the chain terminating moiety embodiments described above. In some embodiments the chain terminating moiety comprises an azide, azido, or azidomethyl group, including any of the potential features listed above.

In some embodiments, in the sequencing methods that employ mutant 9° N DNA polymerases and multivalent molecules, either of which may or may not be fluorescently labeled, and may include any of the fluorophore embodiments described above.

In some embodiments, in the sequencing methods that employ mutant 9° N DNA polymerases and multivalent molecules, the plurality of nucleic acid template molecules may include the nucleic acid template embodiments, including any of the potential features listed above.

In some embodiments, in the sequencing methods that employ mutant 9° N DNA polymerases and multivalent molecules, the plurality of complexed polymerases are immobilized according to the immobilization embodiments, including any of the potential features listed above.

The present disclosure provides two-phase nucleic acid sequencing methods that employ mutant 9° N DNA polymerases, multivalent molecules and nucleotides. The present disclosure provides nucleic acid sequencing methods, comprising: (a) contacting (i) a plurality of a first mutant 9° N DNA polymerase, and (ii) a plurality of nucleic acid duplexes each comprising a nucleic acid template molecule hybridized to a nucleic acid primer, wherein the contacting is conducted under a condition suitable to form a plurality of first complexed polymerases each comprising the first mutant 9° N DNA polymerase bound to the nucleic acid duplex; (b) contacting the plurality of first complexed polymerases with (iii) a plurality of multivalent molecules, and (iv) a plurality of non-catalytic divalent cations, wherein the plurality of multivalent molecules each comprises a core attached to a plurality of nucleotide arms and wherein each nucleotide arm comprises a nucleotide unit, wherein the contacting is conducted under a condition suitable to form a plurality of first ternary complexes each comprising the first mutant 9° N DNA polymerase bound to the nucleic acid duplex and a multivalent molecule, wherein in the first ternary complex, a nucleotide unit of the multivalent molecule is bound to the 3' end of the nucleic acid primer at a position that is opposite a complementary nucleotide in the nucleic acid template molecule, and wherein the contacting is conducted under a condition suitable to inhibit polymerase-catalyzed incorporation of the bound nucleotide units of the multivalent molecules; (c) detecting the plurality of first ternary complexes and identifying the nucleotide units that are bound to the 3' ends of the nucleic acid primers thereby determining the sequences of the nucleic acid template molecules; (d) dissociating the plurality of first ternary complexes by removing the plurality of the first mutant 9° N polymerases and the plurality of multivalent molecules, and retaining the plurality of nucleic acid duplexes; (e) contacting the retained nucleic acid duplexes of step (d) with (i) a plurality of a second mutant 9° N DNA polymerase, (ii) a plurality of nucleotides, and (iii) a plurality of catalytic divalent cations, wherein the contacting of step (e) is conducted under a condition suitable to form a plurality of second ternary complexes each comprising the second mutant 9° N DNA polymerase bound to the retained nucleic acid duplex of step (d) and the nucleotide, wherein in the second ternary complex the nucleotide is bound to the 3' end of the nucleic acid primer at a position that is opposite a complementary nucleotide in the nucleic acid template molecule, and wherein the condition is suitable to promote polymerase-catalyzed incorporation of the nucleotides bound to the 3' ends of the nucleic acid primers; and (f) detecting the plurality of second ternary complexes and identifying the incorporated nucleotides in the second ternary complexes. In some embodiments, the detecting of step (f) is optional. In some embodiments, the identifying of step (f) is optional. In some embodiments, the non-catalytic divalent cation comprises strontium, barium and/or calcium, and the catalytic divalent cation comprises magnesium or manganese.

In some embodiments, the two-phase nucleic acid sequencing methods that employ mutant 9° N polymerases further comprises: (g) removing the plurality of the second mutant 9° N DNA polymerases and retaining the plurality of nucleic acid duplexes of step (f); (h) contacting the retained nucleic acid duplex of step (g) with a plurality of the first mutant 9° N DNA polymerase, a plurality of multivalent molecules, and a plurality of non-catalytic divalent cations, wherein the contacting is conducted under a condition suitable to form another plurality of the first ternary complexes, and wherein the contacting is conducted under a condition suitable to inhibit polymerase-catalyzed incorporation of the bound nucleotide units of the multivalent molecules; (i) detecting the plurality of the first ternary complexes formed in step (h) and identifying the nucleotide units that are bound to the 3' ends of the nucleic acid primers, thereby determining the sequences of the nucleic acid template molecules; (j) dissociating the plurality of the first ternary complexes formed in step (h) by removing the plurality of the first mutant 9° N polymerases and the plurality of the multivalent molecules, and retaining the plurality of the nucleic acid duplexes; (k) contacting the plurality of the retained nucleic acid duplexes of step (j) with a plurality of the second mutant 9° N DNA polymerase, a plurality of nucleotides, and a plurality of catalytic divalent cations, wherein the contacting is conducted under a condition suitable to form another plurality of the second ternary complexes, and wherein the condition is suitable to promote polymerase-catalyzed incorporation of the nucleotides bound to the 3' ends of the nucleic acid primers; (l) detecting the plurality of the second ternary complex formed in step (k) and identifying the plurality of incorporated nucleotides in the second ternary complexes; and (m) repeating steps (g)-(l) at least once. In some embodiments, the detecting of step (l) is optional. In some embodiments, the identifying of step (l) is optional. In some embodiments, the non-catalytic divalent cation comprises strontium, barium and/or calcium, and the catalytic divalent cation comprises magnesium or manganese.

In some embodiments, in the two-phase nucleic acid sequencing methods that employ mutant 9° N polymerases, either of which can be mutated as described earlier.

In some embodiments, in the two-phase nucleic acid sequencing methods that employ mutant 9° N polymerases: the plurality of the first mutant 9° N DNA polymerase forms a plurality of first ternary complexes in step (b) that remain stable without dissociation (or exhibit reduced dissociation) of the first mutant 9° N DNA polymerase from the nucleic acid duplex, and the stable ternary complex exhibits a persistence time of more than 0.1, 0.2, 0.3, 0.4, 0.5, 0.6, 0.7, 0.8, 0.9 or 1 second.

In some embodiments, in the two-phase nucleic acid sequencing methods that employ mutant 9° N polymerases: the plurality of the second mutant 9° N DNA polymerase forms a plurality of first ternary complexes in step (e) that remain stable without dissociation (or exhibit reduced dissociation) of the first mutant 9° N DNA polymerase from the nucleic acid duplex, and the stable ternary complex exhibits a persistence time of more than 0.1, 0.2, 0.3, 0.4, 0.5, 0.6, 0.7, 0.8, 0.9 or 1 second.

In some embodiments, the two-phase nucleic acid sequencing methods that employ mutant 9° N polymerases, in the first ternary complexes the nucleotide unit of the multivalent molecule is bound to the nucleic acid duplex and has not undergone polymerase-catalyzed incorporation, or the nucleotide unit is bound to the nucleic acid duplex and has undergone polymerase-catalyzed incorporation. In some embodiments, in the second ternary complexes, the nucleotide is bound to the nucleic acid duplex and has not undergone polymerase-catalyzed incorporation, or the nucleotide is bound to the nucleic acid duplex and has undergone polymerase-catalyzed incorporation.

In some embodiments, in the two-phase nucleic acid sequencing methods that employ mutant 9° N polymerases, the method further comprise forming an avidity complex as described earlier with in relation to the polymerases from Candidatus Altiarchaeales, including similar steps (steps (1)-(4)) comprising the steps: (a) contacting the plurality of wild type or mutant DNA polymerases and the plurality of nucleic acid primers with different portions of a concatemer nucleic acid template molecule to form at least first and second complexed polymerases on the same concatemer template molecule; (b) contacting a plurality of multivalent molecules to the at least first and second complexed polymerases on the same concatemer template molecule, under conditions suitable to bind a single multivalent molecule from the plurality to the first and second complexed polymerases, wherein at least a first nucleotide unit of the single multivalent molecule is bound to the first complexed polymerase which includes a first primer hybridized to a first portion of the concatemer template molecule thereby forming a first concatemer-ternary complex, and wherein at least a second nucleotide unit of the single multivalent molecule is bound to the second complexed polymerase which includes a second primer hybridized to a second portion of the concatemer template molecule thereby forming a second concatemer-ternary complex, wherein the contacting is conducted under a condition suitable to inhibit polymerase-catalyzed incorporation of the bound first and second nucleotide units in the first and second concatemer-ternary complexes, and wherein the first and second concatemer-ternary complexes which are bound to the same multivalent molecule form an avidity complex; (c) detecting the first and second concatemer-ternary complexes on the same concatemer template molecule; and (d) identifying the first nucleotide unit in the first concatemer-ternary complex thereby determining the sequence of the first portion of the concatemer template molecule, and identifying the second nucleotide unit in the second concatemer-ternary complex thereby determining the sequence of the second portion of the concatemer template molecule. In some embodiments, the identifying of step (d) comprises: identifying the first nucleotide unit that is bound to the 3' end of the first primer in the first concatemer-ternary complex thereby determining the sequence of the first portion of the concatemer template molecule, and identifying the second nucleotide unit that is bound to the 3' end of the second primer in the second concatemer-ternary complex thereby determining the sequence of the second portion of the concatemer template molecule.

In some embodiments, in the two-phase nucleic acid sequencing methods that employ mutant 9° N polymerases: the plurality of the first mutant 9° N DNA polymerase comprises a plurality of fluorescently-labeled first mutant 9° N DNA polymerases. In some embodiments, the plurality of the first mutant 9° N DNA polymerase lacks a fluorophore. In some embodiments, the plurality of the second mutant 9° N DNA polymerase comprises a plurality of fluorescently-labeled first mutant 9° N DNA polymerases. In some embodiments, the plurality of the second mutant 9° N DNA polymerase lacks a fluorophore.

In some embodiments, in the two-phase nucleic acid sequencing methods that employ mutant 9° N polymerases, the multivalent molecule may include any of the multivalent molecule embodiments, including any of the potential features listed above.

In some embodiments, in the two-phase nucleic acid sequencing methods that employ mutant 9° N polymerases: the plurality of multivalent molecules comprise a plurality of fluorescently-labeled multivalent molecules. In some embodiments, the core of individual multivalent molecules in the plurality is attached to a fluorophore which corresponds to the nucleotide units that are attached to the nucleotide arms. In some embodiments, at least one of the nucleotide arms of the multivalent molecule comprises a linker and/or nucleotide base that is attached to a fluorophore, and wherein the fluorophore which is attached to a given linker or nucleotide base corresponds to the nucleotide base (e.g., adenine, guanine, cytosine, thymine or uracil) of the nucleotide arm. In some embodiments, the plurality of multivalent molecules of step (b) are fluorescently-labeled multivalent molecules, and wherein step (c) comprises detecting a fluorescent signal from the plurality of first ternary complexes and identifying the nucleotide units that are bound to the 3' ends of the nucleic acid primers thereby determining the sequences of the nucleic acid template molecules. In some embodiments, the plurality of multivalent molecules lack a fluorophore.

In some embodiments, in the two-phase nucleic acid sequencing methods that employ mutant 9° N polymerases: at least one of the nucleotide units of one or more multivalent molecules in the plurality comprises a chain terminating moiety attached to the 3'—OH sugar position via a cleavable moiety, which may include any of the chain terminating moiety embodiments described above. In some embodiments the chain terminating moiety comprises an azide, azido, or azidomethyl group, including any of the potential features listed above.

In some embodiments, in the two-phase nucleic acid sequencing methods that employ mutant 9° N polymerases: individual nucleotides in the plurality of nucleotides comprise a nucleotide unit that includes one or more example nucleotide unit features as discussed above.

In some embodiments, in the two-phase nucleic acid sequencing methods that employ mutant 9° N polymerases: at least one of the nucleotides in the plurality of nucleotides comprise fluorescently-labeled nucleotides. In some embodiments, the plurality of nucleotides lack a fluorophore label.

In some embodiments, in the two-phase nucleic acid sequencing methods that employ mutant 9° N polymerases: the plurality of the second mutant 9° N DNA polymerases comprises a plurality of polymerases which may or may not be fluorescently labeled, and may include any of the fluorophore embodiments described above. In some embodiments that plurality of polymerases comprise one or more nucleotides any of which may or may not be fluorescently labeled, and may include any of the fluorophore embodiments described above.

In some embodiments, in the two-phase nucleic acid sequencing methods that employ mutant 9° N polymerases: at least one of the nucleotides in the plurality of nucleotides comprises a chain terminating moiety attached to the 3'—OH sugar position via a cleavable moiety, which may include any of the chain terminating moiety embodiments described above. In some embodiments the chain terminating moiety comprises an azide, azido, or azidomethyl group, including any of the potential features listed above.

In some embodiments, in the two-phase nucleic acid sequencing methods that employ mutant 9° N polymerases: when the plurality of nucleotides in step (e) comprise a chain terminating moiety attached to the 3'—OH sugar position via a cleavable moiety, then step (f) further comprises contacting the chain terminating nucleotides incorporated into the nucleic acid primers with a cleaving agent to remove the chain terminating moieties thereby generating a plurality of nucleic acid primers having 3' extendible ends.

In some embodiments, in the two-phase nucleic acid sequencing methods that employ mutant 9° N polymerases: the plurality of nucleic acid template molecules may include the nucleic acid template embodiments, including any of the potential features listed above.

In some embodiments, in the two-phase nucleic acid sequencing methods that employ mutant 9° N polymerases: the plurality of first complexed polymerases are immobilized according to the immobilization embodiments, including any of the potential features listed above

BRIEF DESCRIPTION OF THE DRAWINGS

The patent or application file contains at least one drawing executed in color. Copies of this patent or patent application publication with color drawing(s) will be provided by the U.S. Patent and Trademark Office upon request and payment of the necessary fee.

The novel advantages and features of the compositions and methods disclosed herein are set forth with particularity in the appended claims. A better understanding of the features and advantages of the compositions and methods of the present disclosure will be obtained by reference to the following detailed description that sets forth illustrative embodiments and the accompanying drawings of which:

FIG. 3-1 to FIG. 3-8: (8 sheets, presented as FIG. 3-1 through FIG. 3-8) is Table 1 (8 sheets) which lists the relative incorporation activity of wild type (SEQ ID NO: 1) and mutant variants (SEQ ID NOS: 2-157) of DNA polymerases from Candidatus Altiarchaeales archaeon, in incorporation of 3'methylazido nucleotides at the N+1 position of an extending polynucleotide chain at 42° C. Variants are present in cleared lysates from expression strains. All of the mutant polymerases listed in Table 1 (SEQ ID NOS: 2-157) include the substitution mutations D141A and E143A even when the genotypes do not list these substitute mutations in Table 1.

FIG. 4-1 through FIG. 4-5 (4 sheets, presented as FIG. 4-1 through FIG. 4-5) is Table 2 (5 sheets) which lists the relative incorporation activity of mutant variants (SEQ ID NOS: 158-255) of DNA polymerases from Candidatus Altiarchaeales archaeon, in incorporation of 3'methylazido nucleotides at the N+1 position of an extending polynucleotide chain at 42° C. Variants are present in cleared lysates from expression strains. All of the mutant polymerases listed in Table 2 (SEQ ID NOS: 158-255) include the substitution mutations D141A and E143A even when the genotypes do not list these substitute mutations in Table 2.

FIG. 5-1 through FIG. 5-5 is Table 3 (5 sheets, presented as FIG. 5-1 through FIG. 5-5) which lists the relative incorporation activity of mutant variants (SEQ ID NOS: 288-375 and 385-390 and 394-397) of DNA polymerases from Candidatus Altiarchaeales archaeon, in incorporation of 3'methylazido nucleotides at the N+1 position of an extending polynucleotide chain at 42° C. Variants are present in cleared lysates from expression strains. The mutant polymerases having amino acid sequences SEQ ID NOS: 353,354 and 386 are truncated mutants, where the truncated site is indicated with an asterisk (*). All of the mutant polymerases listed in Table 3 (SEQ ID NOS: 288-375 and 385-390) include the substitution mutations D141A and E143A even when the genotypes do not list these substitute mutations in Table 3.

FIG. 6-1 through FIG. 6-3 is Table 4 (3 sheets, presented as FIG. 6-1 through FIG. 6-3) which lists various amino acid substitution mutations in DNA polymerase from Candidatus altiarchaeales archaeon (relative to SEQ ID NO: 1) and the equivalent amino acid substitution mutations in 9° N DNA polymerase (relative to SEQ ID NO: 280), VENT DNA polymerase (relative to SEQ ID NO: 283), DEEP VENT DNA polymerase (relative to SEQ ID NO: 284), *Geobacillus stearothermophilus* DNA polymerase (relative to SEQ ID NO: 275), Pfu DNA polymerase (relative to SEQ ID NO: 285), and *Pyrococcus abyssi* DNA polymerase (relative to SEQ ID NO: 286).

FIG. 7 (2 sheets, presented as FIG. 7-1 through FIG. 7-2) is an amino acid sequence alignment between wild type DNA polymerase from Candidatus altiarchaeales archaeon (relative to SEQ ID NO: 1) and 9° N DNA polymerase (relative to SEQ ID NO: 280).

FIG. 8 (3 sheets, presented as FIG. 8-1 through FIG. 8-3) is an amino acid sequence alignment between wild type DNA polymerase from Candidatus altiarchaeales archaeon (relative to SEQ ID NO: 1) and VENT DNA polymerase (relative to SEQ ID NO: 283).

FIG. 9 (2 sheets, presented as FIG. 9-1 through FIG. 9-2) is an amino acid sequence alignment between wild type DNA polymerase from Candidatus altiarchaeales archaeon (relative to SEQ ID NO: 1) and DEEP VENT DNA polymerase (relative to SEQ ID NO: 284).

FIG. 10 (2 sheets, presented as FIG. 10-1 through FIG. 10-2) is an amino acid sequence alignment between wild type DNA polymerase from Candidatus altiarchaeales archaeon (relative to SEQ ID NO: 1) and *Geobacillus stearothermophilus* DNA polymerase (relative to SEQ ID NO: 275).

FIG. 11 (2 sheets, presented as FIG. 11-1 through FIG. 11-2) is an amino acid sequence alignment between wild type DNA polymerase from Candidatus altiarchaeales archaeon (relative to SEQ ID NO: 1) and Pfu DNA polymerase (relative to SEQ ID NO: 285).

FIG. 12 (2 sheets, presented as FIG. 12-1 through FIG. 12-2) is an amino acid sequence alignment between wild type DNA polymerase from Candidatus altiarchaeales archaeon (relative to SEQ ID NO: 1) and *Pyrococcus abyssi* polymerase (relative to SEQ ID NO: 286).

FIG. 13 (2 sheets, presented as FIG. 13-1 through FIG. 13-2) is an amino acid sequence alignment between wild type DNA polymerase from Candidatus altiarchaeales archaeon (relative to SEQ ID NO: 1) and RB69 polymerase (relative to SEQ ID NO: 287).

FIG. 16A shows the chemical structure of an exemplary spacer, and the chemical structures of various exemplary linkers, including an 11-atom Linker, 16-atom Linker, 23-atom Linker and an N3 Linker.

FIG. 16B shows the chemical structures of various exemplary linker, including Linkers 1-9.

FIG. 17A shows the chemical structures of various exemplary linkers joined/attached to nucleotide units.

FIG. 17B shows the chemical structures of various exemplary linkers joined/attached to nucleotide units.

FIG. 17C shows the chemical structures of various exemplary linkers joined/attached to nucleotide units.

DETAILED DESCRIPTION

Definitions

Figure 1:
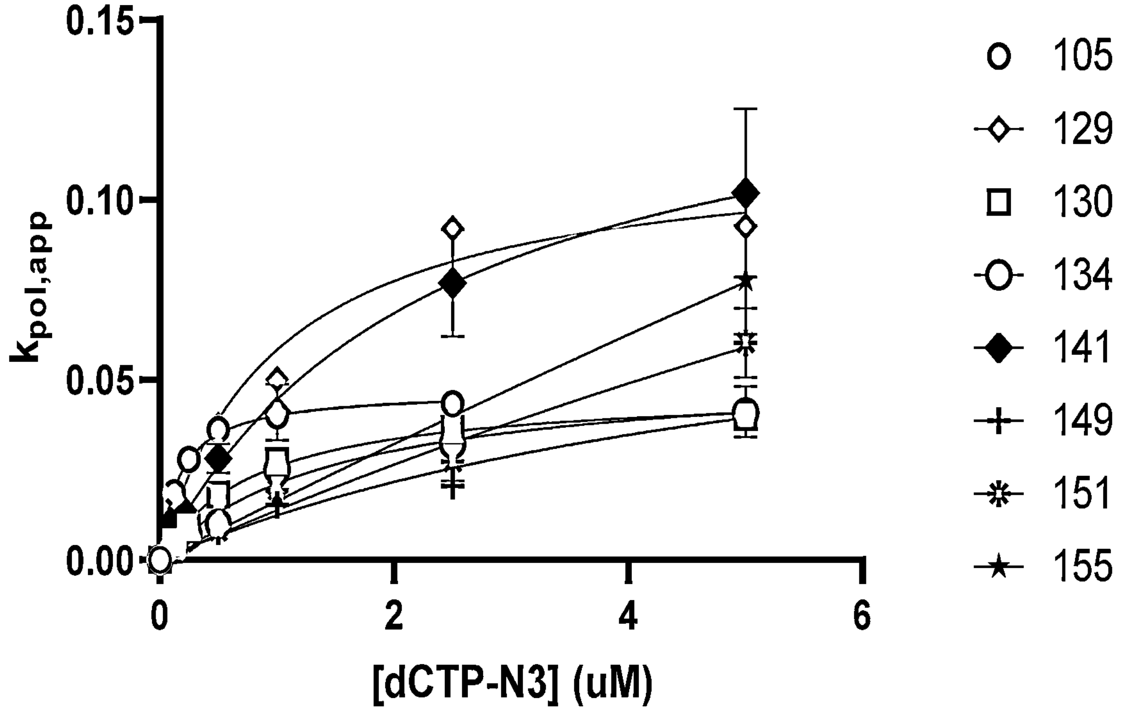
FIG. 1 is a graph comparing the rate of product formation of purified wild-type and mutant DNA polymerases from Candidatus Altiarchaeales archaeon in the presence of 3'methylazido dCTP at various nucleotide concentrations. The graph shows data for mutant polymerases having amin acid sequences of SEQ ID NOs: 105, 129, 130, 134, 141, 149, 151 and 155.

The headings provided herein are not limitations of the various aspects of the disclosure, which aspects can be understood by reference to the specification as a whole.

Unless defined otherwise, technical and scientific terms used herein have meanings that are commonly understood by those of ordinary skill in the art unless defined otherwise. Generally, terminologies pertaining to techniques of molecular biology, nucleic acid chemistry, protein chemistry, genetics, microbiology, transgenic cell production, and hybridization described herein are those well-known and commonly used in the art. Techniques and procedures described herein are generally performed according to conventional methods well known in the art and as described in various general and more specific references that are cited and discussed throughout the instant specification. For example, see Sambrook et al., Molecular Cloning: A Laboratory Manual (Third ed., Cold Spring Harbor Laboratory Press, Cold Spring Harbor, N.Y. 2000). See also Ausubel et al., Current Protocols in Molecular Biology, Greene Publishing Associates (1992). The nomenclatures utilized in connection with, and the laboratory procedures and techniques described herein are those well-known and commonly used in the art.

Unless otherwise required by context herein, singular terms shall include pluralities and plural terms shall include the singular. Singular forms "a", "an" and "the", and singular use of any word, include plural referents unless expressly and unequivocally limited on one referent.

It is understood the use of the alternative term (e.g., "or") is taken to mean either one or both or any combination thereof of the alternatives.

The term "and/or" used herein is to be taken mean specific disclosure of each of the specified features or components with or without the other. For example, the term "and/or" as used in a phrase such as "A and/or B" herein is intended to include: "A and B"; "A or B"; "A" (A alone); and "B" (B alone). In a similar manner, the term "and/or" as used in a phrase such as "A, B, and/or C" is intended to encompass each of the following aspects: "A, B, and C"; "A, B, or C";

"A or C"; "A or B"; "B or C"; "A and B"; "B and C"; "A and C"; "A" (A alone); "B" (B alone); and "C" (C alone).

As used herein and in the appended claims, terms "comprising", "including", "having" and "containing", and their grammatical variants, as used herein are intended to be non-limiting so that one item or multiple items in a list do not exclude other items that can be substituted or added to the listed items. It is understood that wherever aspects are described herein with the language "comprising," otherwise analogous aspects described in terms of "consisting of" and/or "consisting essentially of" are also provided.

As used herein, the terms "about" and "approximately" refer to a value or composition that is within an acceptable error range for the particular value or composition as determined by one of ordinary skill in the art, which will depend in part on how the value or composition is measured or determined, i.e., the limitations of the measurement system. For example, "about" or "approximately" can mean within one or more than one standard deviation per the practice in the art. Alternatively, "about" or "approximately" can mean a range of up to 10% (i.e., ±10%) or more depending on the limitations of the measurement system. For example, about 5 mg can include any number between 4.5 mg and 5.5 mg. Furthermore, particularly with respect to biological systems or processes, the terms can mean up to an order of magnitude or up to 5-fold of a value. When particular values or compositions are provided in the instant disclosure, unless otherwise stated, the meaning of "about" or "approximately" should be assumed to be within an acceptable error range for that particular value or composition. Also, where ranges and/or subranges of values are provided, the ranges and/or subranges can include the endpoints of the ranges and/or subranges.

The terms "peptide", "polypeptide" and "protein" and other related terms used herein are used interchangeably and refer to a polymer of amino acids and are not limited to any particular length. Polypeptides may comprise natural and non-natural amino acids. Polypeptides include recombinant or chemically-synthesized forms. Polypeptides also include precursor molecules that have not yet been subjected to post-translation modification such as proteolytic cleavage, cleavage due to ribosomal skipping, hydroxylation, methylation, lipidation, acetylation, SUMOylation, ubiquitination, glycosylation, phosphorylation and/or disulfide bond formation. These terms encompass native and artificial proteins, protein fragments and polypeptide analogs (such as muteins, variants, chimeric proteins and fusion proteins) of a protein sequence as well as post-translationally, or otherwise covalently or non-covalently, modified proteins.

The term "polymerase" and its variants, as used herein, comprises any enzyme that can catalyze polymerization of nucleotides (including analogs thereof) into a nucleic acid strand. Typically, but not necessarily such nucleotide polymerization can occur in a template-dependent fashion. Typically, a polymerase comprises one or more active sites at which nucleotide binding and/or catalysis of nucleotide polymerization can occur. In some embodiments, a polymerase includes other enzymatic activities, such as for example, 3' to 5' exonuclease activity or 5' to 3' exonuclease activity. In some embodiments, a polymerase has strand displacing activity. A polymerase can include without limitation naturally occurring polymerases and any subunits and truncations thereof, mutant polymerases, variant polymerases, recombinant, fusion or otherwise engineered polymerases, chemically modified polymerases, synthetic molecules or assemblies, and any analogs, derivatives or fragments thereof that retain the ability to catalyze nucleotide polymerization (e.g., catalytically active fragment). In some embodiments, a polymerase can be isolated from a cell, or generated using recombinant DNA technology or chemical synthesis methods. In some embodiments, a polymerase can be expressed in prokaryote, eukaryote, viral, or phage organisms. In some embodiments, a polymerase can be post-translationally modified proteins or fragments thereof. A polymerase can be derived from a prokaryote, eukaryote, virus or phage. A polymerase comprises DNA-directed DNA polymerase and RNA-directed DNA polymerase.

As used herein, the term "fidelity" refers to the accuracy of DNA polymerization by template-dependent DNA polymerase. The fidelity of a DNA polymerase is typically measured by the error rate (the frequency of incorporating an inaccurate nucleotide, i.e., a nucleotide that is not complementary to the template nucleotide). The accuracy or fidelity of DNA polymerization is maintained by both the polymerase activity and the 3'-5' exonuclease activity of a DNA polymerase.

As used herein, the term "binding complex" refers to a complex formed by binding together a nucleic acid duplex, a polymerase, and a free nucleotide or a nucleotide unit of a multivalent molecule, where the nucleic acid duplex comprises a nucleic acid template molecule hybridized to a nucleic acid primer. In the binding complex, the free nucleotide or nucleotide unit may or may not be bound to the 3' end of the nucleic acid primer at a position that is opposite a complementary nucleotide in the nucleic acid template molecule. A "ternary complex" is an example of a binding complex which is formed by binding together a nucleic acid duplex, a polymerase, and a free nucleotide or nucleotide unit of a multivalent molecule, where the free nucleotide or nucleotide unit is bound to the 3' end of the nucleic acid primer (as part of the nucleic acid duplex) at a position that is opposite a complementary nucleotide in the nucleic acid template molecule.

The term "persistence time" and related terms refers to the length of time that a binding complex remains stable without dissociation of any of the components, where the components of the binding complex include a nucleic acid template and nucleic acid primer, a polymerase, a nucleotide unit of a multivalent molecule or a free (e.g., unconjugated) nucleotide. The nucleotide unit or the free nucleotide can be complementary or non-complementary to a nucleotide residue in the template molecule. The nucleotide unit or the free nucleotide can bind to the 3' end of the nucleic acid primer at a position that is opposite a complementary nucleotide residue in the nucleic acid template molecule. The persistence time is indicative of the stability of the binding complex and strength of the binding interactions. Persistence time can be measured by observing the onset and/or duration of a binding complex, such as by observing a signal from a labeled component of the binding complex. For example, a labeled nucleotide or a labeled reagent comprising one or more nucleotides may be present in a binding complex, thus allowing the signal from the label to be detected during the persistence time of the binding complex. One exemplary label is a fluorescent label. The binding complex (e.g., ternary complex) remains stable until subjected to a condition that causes dissociation of interactions between any of the polymerase, template molecule, primer and/or the nucleotide unit or the nucleotide. For example, a dissociating condition comprises contacting the binding complex with any one or any combination of a detergent, EDTA and/or water. In some embodiments, the binding complexes remains stable without dissociation for a persistence time of more than 0.1, 0.2, 0.3, 0.4, 0.5, 0.6, 0.7, 0.8, 0.9 or 1 second.

The terms "nucleic acid", "polynucleotide" and "oligonucleotide" and other related terms used herein are used interchangeably and refer to polymers of nucleotides and are not limited to any particular length. Nucleic acids include recombinant and chemically-synthesized forms. Nucleic acids include DNA molecules (e.g., cDNA or genomic DNA), RNA molecules (e.g., mRNA), analogs of the DNA or RNA generated using nucleotide analogs (e.g., peptide nucleic acids and non-naturally occurring nucleotide analogs), and chimeric forms containing DNA and RNA. Nucleic acids can be single-stranded or double-stranded. Nucleic acids comprise polymers of nucleotides, where the nucleotides include natural or non-natural bases and/or sugars. Nucleic acids comprise naturally-occurring internucleosidic linkages, for example phosphodiester linkages. Nucleic acids comprise non-natural internucleoside linkages, including phosphorothioate, phosphorothiolate, or peptide nucleic acid (PNA) linkages. In some embodiments, nucleic acids comprise a one type of polynucleotides or a mixture of two or more different types of polynucleotides.

The term "primer" and related terms used herein refers to an oligonucleotide, either natural or synthetic, that is capable of hybridizing with a DNA and/or RNA polynucleotide template to form a duplex molecule. Primers may have any length, but typically range from 4-50 nucleotides. A typical primer comprises a 5' end and 3' end. The 3' end of the primer can include a 3' OH moiety which serves as a nucleotide polymerization initiation site in a polymerase-mediated primer extension reaction. Alternatively, the 3' end of the primer can lack a 3' OH moiety, or can include a terminal 3' blocking group that inhibits nucleotide polymerization in a polymerase-mediated reaction. Any one nucleotide, or more than one nucleotide, along the length of the primer can be labeled with a detectable reporter moiety. A primer can be in solution (e.g., a soluble primer) or can be immobilized to a support (e.g., a capture primer).

The term "template nucleic acid", "template polynucleotide", "target nucleic acid" "target polynucleotide", "template strand" and other variations refer to a nucleic acid strand that serves as the basis nucleic acid molecule for generating a complementary nucleic acid strand. The sequence of the template nucleic acid can be partially or wholly complementary to the sequence of the complementary strand. The template nucleic acid can be obtained from a naturally-occurring source, recombinant form, or chemically synthesized to include any type of nucleic acid analog. The template nucleic acid can be linear, circular, or other forms. The template nucleic acids can be isolated in any form, including chromosomal, genomic, organellar (e.g., mitochondrial, chloroplast or ribosomal), recombinant molecules, cloned, amplified, cDNA, RNA such as precursor mRNA or mRNA, oligonucleotides, whole genomic DNA, obtained from fresh frozen paraffin embedded tissue, needle biopsies, cell free circulating DNA, or any type of nucleic acid library. The template nucleic acid molecules may be isolated from any source including from organisms such as prokaryotes, eukaryotes (e.g., humans, plants and animals), fungus, and viruses; cells; tissues; normal or diseased cells or tissues, body fluids including blood, urine, serum, lymph, tumor, saliva, anal and vaginal secretions, amniotic samples, perspiration, and semen; environmental samples; culture samples; or synthesized nucleic acid molecules prepared using recombinant molecular biology or chemical synthesis methods. The template nucleic acid can be subjected to nucleic acid analysis, including sequencing and composition analysis.

When used in reference to nucleic acid molecules, the terms "hybridize" or "hybridizing" or "hybridization" or other related terms refers to hydrogen bonding between two different nucleic acids to form a duplex nucleic acid. Hybridization also includes hydrogen bonding between two different regions of a single nucleic acid molecule to form a self-hybridizing molecule having a duplex region. Hybridization can comprise Watson-Crick or Hoogstein binding to form a duplex double-stranded nucleic acid, or a double-stranded region within a nucleic acid molecule. The double-stranded nucleic acid, or the two different regions of a single nucleic acid, may be wholly complementary, or partially complementary. Complementary nucleic acid strands need not hybridize with each other across their entire length. The complementary base pairing can be the standard A-T or C-G base pairing, or can be other forms of base-pairing interactions. Duplex nucleic acids can include mismatched base-paired nucleotides.

The term "nucleotides" and related terms refers to a molecule comprising an aromatic base, a five carbon sugar (e.g., ribose or deoxyribose), and at least one phosphate group. Canonical or non-canonical nucleotides are consistent with use of the term. The phosphate in some embodiments comprises a monophosphate, diphosphate, or triphosphate, or corresponding phosphate analog. In some embodiments, the nucleotide comprises 1, 2, 3, 4, 5, 6, 7, 8, 9 or 10 phosphate groups. The term "nucleoside" refers to a molecule comprising an aromatic base and a sugar.

Nucleotides (and nucleosides) typically comprise a hetero cyclic base including substituted or unsubstituted nitrogen-containing parent heteroaromatic ring which are commonly found in nucleic acids, including naturally-occurring, substituted, modified, or engineered variants, or analogs of the same. The base of a nucleotide (or nucleoside) is capable of forming Watson-Crick and/or Hoogstein hydrogen bonds with an appropriate complementary base. Exemplary bases include, but are not limited to, purines and pyrimidines such as: 2-aminopurine, 2,6-diaminopurine, adenine (A), ethenoadenine, $N^6$-$\Delta^2$-isopentenyladenine (6iA), $N^6$-$\Delta^2$-isopentenyl-2-methylthioadenine (2ms6iA), $N^6$-methyladenine, guanine (G), isoguanine, $N^2$-dimethylguanine (dmG), 7-methylguanine (7 mG), 2-thiopyrimidine, 6-thioguanine (6sG), hypoxanthine and $O^6$-methylguanine; 7-deaza-purines such as 7-deazaadenine (7-deaza-A) and 7-deazaguanine (7-deaza-G); pyrimidines such as cytosine (C), 5-propynylcytosine, isocytosine, thymine (T), 4-thiothymine (4sT), 5,6-dihydrothymine, $O^4$-methylthymine, uracil (U), 4-thiouracil (4sU) and 5,6-dihydrouracil (dihydrouracil; D); indoles such as nitroindole and 4-methylindole; pyrroles such as nitropyrrole; nebularine; inosines; hydroxymethylcytosines; 5-methycytosines; base (Y); as well as methylated, glycosylated, and acylated base moieties; and the like. Additional exemplary bases can be found in Fasman, 1989, in "Practical Handbook of Biochemistry and Molecular Biology", pp. 385-394, CRC Press, Boca Raton, Fla.

Nucleotides (and nucleosides) typically comprise a sugar moiety, such as carbocyclic moiety (Ferraro and Gotor 2000 Chem. Rev. 100: 4319-48), acyclic moieties (Martinez, et al., 1999 Nucleic Acids Research 27: 1271-1274; Martinez, et al., 1997 Bioorganic & Medicinal Chemistry Letters vol. 7: 3013-3016), and other sugar moieties (Joeng, et al., 1993 J. Med. Chem. 36: 2627-2638; Kim, et al., 1993 J. Med. Chem. 36: 30-7; Eschenmosser 1999 Science 284:2118-2124; and U.S. Pat. No. 5,558,991). The sugar moiety comprises: ribosyl; 2'-deoxyribosyl; 3'-deoxyribosyl; 2',3'-dideoxyribosyl; 2',3'-didehydrodideoxyribosyl; 2'-alkoxyribosyl; 2'-azidoribosyl; 2'-aminoribosyl; 2'-fluororibosyl; 2'-mercaptoriboxyl; 2'-alkylthioribosyl; 3'-alkoxyribosyl; 3'-azidoribosyl; 3'-aminoribosyl; 3'-fluororibosyl; 3'-mercaptoriboxyl; 3'-alkylthioribosyl carbocyclic; acyclic or other modified sugars.

In some embodiments, nucleotides comprise a chain of one, two or three phosphorus atoms where the chain is typically attached to the 5' carbon of the sugar moiety via an ester or phosphoramide linkage. In some embodiments, the nucleotide is an analog having a phosphorus chain in which the phosphorus atoms are linked together with intervening 0, S, NH, methylene or ethylene. In some embodiments, the phosphorus atoms in the chain include substituted side groups including O, S or $BH_3$. In some embodiments, the chain includes phosphate groups substituted with analogs including phosphoramidate, phosphorothioate, phosphorodithioate, and O-methylphosphoroamidite groups.

When used in reference to nucleic acids, the terms “extend”, “extending”, “extension” and other variants, refers to incorporation of one or more nucleotides into a nucleic acid molecule. Nucleotide incorporation comprises polymerization of one or more nucleotides into the terminal 3' OH end of a nucleic acid strand, resulting in extension of the nucleic acid strand. Nucleotide incorporation can be conducted with natural nucleotides and/or nucleotide analogs. Typically, but not necessarily, nucleotide incorporation occurs in a template-dependent fashion. Any suitable method of extending a nucleic acid molecule may be used, including primer extension catalyzed by a DNA polymerase or RNA polymerase.

The term “reporter moiety”, “reporter moieties” or related terms refers to a compound that generates, or causes to generate, a detectable signal. A reporter moiety is sometimes called a “label”. Any suitable reporter moiety may be used, including luminescent, photoluminescent, electroluminescent, bioluminescent, chemiluminescent, fluorescent, phosphorescent, chromophore, radioisotope, electrochemical, mass spectrometry, Raman, hapten, affinity tag, atom, or an enzyme. A reporter moiety generates a detectable signal resulting from a chemical or physical change (e.g., heat, light, electrical, pH, salt concentration, enzymatic activity, or proximity events). A proximity event includes two reporter moieties approaching each other, or associating with each other, or binding each other. It is well known to one skilled in the art to select reporter moieties so that each absorbs excitation radiation and/or emits fluorescence at a wavelength distinguishable from the other reporter moieties to permit monitoring the presence of different reporter moieties in the same reaction or in different reactions. Two or more different reporter moieties can be selected having spectrally distinct emission profiles, or having minimal overlapping spectral emission profiles. Reporter moieties can be linked (e.g., operably linked) to nucleotides, nucleosides, nucleic acids, enzymes (e.g., polymerases or reverse transcriptases), or support (e.g., surfaces).

A reporter moiety (or label) comprises a fluorescent label or a fluorophore. Exemplary fluorescent moieties which may serve as fluorescent labels or fluorophores include, but are not limited to fluorescein and fluorescein derivatives such as carboxyfluorescein, tetrachlorofluorescein, hexachlorofluorescein, carboxynapthofluorescein, fluorescein isothiocyanate, NHS-fluorescein, iodoacetamidofluorescein, fluorescein maleimide, SAMSA-fluorescein, fluorescein thiosemicarbazide, carbohydrazinomethylthioacetyl-amino fluorescein, rhodamine and rhodamine derivatives such as TRITC, TMR, lissamine rhodamine, Texas Red, rhodamine B, rhodamine 6G, rhodamine 10, NHS-rhodamine, TMR-iodoacetamide, lissamine rhodamine B sulfonyl chloride, lissamine rhodamine B sulfonyl hydrazine, Texas Red sulfonyl chloride, Texas Red hydrazide, coumarin and coumarin derivatives such as AMCA, AMCA-NHS, AMCA-sulfo-NHS, AMCA-HPDP, DCIA, AMCE-hydrazide, BODIPY and derivatives such as BODIPY FL C3-SE, BODIPY 530/550 C3, BODIPY 530/550 C3-SE, BODIPY 530/550 C3 hydrazide, BODIPY 493/503 C3 hydrazide, BODIPY FL C3 hydrazide, BODIPY FL IA, BODIPY 530/551 IA, Br-BODIPY 493/503, Cascade Blue and derivatives such as Cascade Blue acetyl azide, Cascade Blue cadaverine, Cascade Blue ethylenediamine, Cascade Blue hydrazide, Lucifer Yellow and derivatives such as Lucifer Yellow iodoacetamide, Lucifer Yellow CH, cyanine and derivatives such as indolium based cyanine dyes, benzo-indolium based cyanine dyes, pyridium based cyanine dyes, thiazolium based cyanine dyes, quinolinium based cyanine dyes, imidazolium based cyanine dyes, Cy 3, Cy5, lanthanide chelates and derivatives such as BCPDA, TBP, TMT, BHHCT, BCOT, Europium chelates, Terbium chelates, Alexa Fluor dyes, DyLight dyes, Atto dyes, LightCycler Red dyes, CAL Flour dyes, JOE and derivatives thereof, Oregon Green dyes, WellRED dyes, IRD dyes, phycoerythrin and phycobilin dyes, Malachite green, stilbene, DEG dyes, NR dyes, near-infrared dyes and others known in the art such as those described in Haugland, Molecular Probes Handbook, (Eugene, Oreg.) 6th Edition; Lakowicz, Principles of Fluorescence Spectroscopy, 2nd Ed., Plenum Press New York (1999), or Hermanson, Bioconjugate Techniques, 2nd Edition, or derivatives thereof, or any combination thereof. Cyanine dyes may exist in either sulfonated or non-sulfonated forms, and consist of two indolenin, benzo-indolium, pyridium, thiozolium, and/or quinolinium groups separated by a polymethine bridge between two nitrogen atoms. Commercially available cyanine fluorophores include, for example, Cy3, (which may comprise 1-[6-(2,5-dioxopyrrolidin-1-yloxy)-6-oxohexyl]-2-(3-{1-[6-(2,5-dioxopyrrolidin-1-yloxy)-6-oxohexyl]-3,3-dimethyl-1,3-dihydro-2H-indol-2-ylidene}prop-1-en-1-yl)-3,3-dimethyl-3H-indolium or 1-[6-(2,5-dioxopyrrolidin-1-yloxy)-6-oxohexyl]-2-(3-{1-[6-(2,5-dioxopyrrolidin-1-yloxy)-6-oxohexyl]-3,3-dimethyl-5-sulfo-1,3-dihydro-2H-indol-2-ylidene}prop-1-en-1-yl)-3,3-dimethyl-3H-indolium-5-sulfonate), Cy5 (which may comprise 1-(6-((2,5-dioxopyrrolidin-1-yl)oxy)-6-oxohexyl)-2-((1E,3E)-5-((E)-1-(6-((2,5-dioxopyrrolidin-1-yl)oxy)-6-oxohexyl)-3,3-dimethyl-5-indolin-2-ylidene)penta-1,3-dien-1-yl)-3,3-dimethyl-3H-indol-1-ium or 1-(6-((2,5-dioxopyrrolidin-1-yl)oxy)-6-oxohexyl)-2-((1E,3E)-5-((E)-1-(6-((2,5-dioxopyrrolidin-1-yl)oxy)-6-oxohexyl)-3,3-dimethyl-5-sulfoindolin-2-ylidene)penta-1,3-dien-1-yl)-3,3-dimethyl-3H-indol-1-ium-5-sulfonate), and Cy7 (which may comprise 1-(5-carboxypentyl)-2-[(1E,3E,5E,7Z)-7-(1-ethyl-1,3-dihydro-2H-indol-2-ylidene)hepta-1,3,5-trien-1-yl]-3H-indolium or 1-(5-carboxypentyl)-2-[(1E,3E,5E,7Z)-7-(1-ethyl-5-sulfo-1,3-dihydro-2H-indol-2-ylidene)hepta-1,3,5-trien-1-yl]-3H-indolium-5-sulfonate), where “Cy” stands for ‘cyanine’, and the first digit identifies the number of carbon atoms between two indolenine groups. Cy2 which is an oxazole derivative rather than indolenin, and the benzo-derivatized Cy3.5, Cy5.5 and Cy7.5 are exceptions to this rule.

In some embodiments, the reporter moiety can be a FRET pair, such that multiple classifications can be performed under a single excitation and imaging step. As used herein, FRET may comprise excitation exchange (Forster) transfers, or electron-exchange (Dexter) transfers.

The terms "linked", "joined", "attached", and variants thereof comprise any type of fusion, bond, adherence or association between any combination of compounds or molecules that is of sufficient stability to withstand use in the particular procedure. The procedure can include but are not limited to: nucleotide transient-binding; nucleotide incorporation; de-blocking; washing; removing; flowing; detecting; imaging and/or identifying. Such linkage can comprise, for example, covalent, ionic, hydrogen, dipole-dipole, hydrophilic, hydrophobic, or affinity bonding, bonds or associations involving van der Waals forces, mechanical bonding, and the like. In some embodiments, such linkage occurs intramolecularly, for example linking together the ends of a single-stranded or double-stranded linear nucleic acid molecule to form a circular molecule. In some embodiments, such linkage can occur between a combination of different molecules, or between a molecule and a non-molecule, including but not limited to: linkage between a nucleic acid molecule and a solid surface; linkage between a protein and a detectable reporter moiety; linkage between a nucleotide and detectable reporter moiety; and the like. Some examples of linkages can be found, for example, in Hermanson, G., "Bioconjugate Techniques", Second Edition (2008); Aslam, M., Dent, A., "Bioconjugation: Protein Coupling Techniques for the Biomedical Sciences", London: Macmillan (1998); Aslam, M., Dent, A., "Bioconjugation: Protein Coupling Techniques for the Biomedical Sciences", London: Macmillan (1998).

The term "operably linked" and "operably joined" or related terms as used herein refers to juxtaposition of components. The juxtapositioned components can be linked together covalently. For example, two nucleic acid components can be enzymatically ligated together where the linkage that joins together the two components comprises phosphodiester linkage. A first and second nucleic acid component can be linked together, where the first nucleic acid component can confer a function on a second nucleic acid component. For example, linkage between a primer binding sequence and a sequence of interest forms a nucleic acid library molecule having a portion that can bind to a primer. In another example, a transgene (e.g., a nucleic acid encoding a polypeptide or a nucleic acid sequence of interest) can be ligated to a vector where the linkage permits expression or functioning of the transgene sequence contained in the vector. In some embodiments, a transgene is operably linked to a host cell regulatory sequence (e.g., a promoter sequence) that affects expression of the transgene. In some embodiments, the vector comprises at least one host cell regulatory sequence, including a promoter sequence, enhancer, transcription and/or translation initiation sequence, transcription and/or translation termination sequence, polypeptide secretion signal sequences, and the like. In some embodiments, the host cell regulatory sequence controls expression of the level, timing and/or location of the transgene.

In some embodiments, the support is solid, semi-solid, or a combination of both. In some embodiments, the support is porous, semi-porous, non-porous, or any combination of porosity. In some embodiments, the support can be substantially planar, concave, convex, or any combination thereof. In some embodiments, the support can be cylindrical, for example comprising a capillary or interior surface of a capillary.

In some embodiments, the surface of the support can be substantially smooth. In some embodiments, the support can be regularly or irregularly textured, including bumps, etched, pores, three-dimensional scaffolds, or any combination thereof.

In some embodiments, the support comprises a bead having any shape, including spherical, hemi-spherical, cylindrical, barrel-shaped, toroidal, disc-shaped, rod-like, conical, triangular, cubical, polygonal, tubular or wire-like.

The support can be fabricated from any material, including but not limited to glass, fused-silica, silicon, a polymer (e.g., polystyrene (PS), macroporous polystyrene (MPPS), polymethylmethacrylate (PMMA), polycarbonate (PC), polypropylene (PP), polyethylene (PE), high density polyethylene (HDPE), cyclic olefin polymers (COP), cyclic olefin copolymers (COC), polyethylene terephthalate (PET)), or any combination thereof. Various compositions of both glass and plastic substrates are contemplated.

In some embodiments, the surface of the support is coated with one or more compounds to produce a passivated layer on the support. In some embodiments, the support comprises a low non-specific binding surface that enable improved nucleic acid hybridization and amplification performance on the support. In general, the support may comprise one or more layers of a covalently or non-covalently attached low-binding, chemical modification layers, e.g., silane layers, polymer films, and one or more covalently or non-covalently attached oligonucleotides that may be used for immobilizing a plurality of nucleic acid template molecules to the support.

In some embodiments, the degree of hydrophilicity (or "wettability" with aqueous solutions) of the surface coatings may be assessed, for example, through the measurement of water contact angles in which a small droplet of water is placed on the surface and its angle of contact with the surface is measured using, e.g., an optical tensiometer. In some embodiments, a static contact angle may be determined. In some embodiments, an advancing or receding contact angle may be determined. In some embodiments, the water contact angle for the hydrophilic, low-binding support surfaced disclosed herein may range from about 0 degrees to about 30 degrees. In some embodiments, the water contact angle for the hydrophilic, low-binding support surfaced disclosed herein may no more than 50 degrees, 40 degrees, 30 degrees, 25 degrees, 20 degrees, 18 degrees, 16 degrees, 14 degrees, 12 degrees, 10 degrees, 8 degrees, 6 degrees, 4 degrees, 2 degrees, or 1 degree. In many cases the contact angle is no more than 40 degrees. Those of skill in the art will realize that a given hydrophilic, low-binding support surface of the present disclosure may exhibit a water contact angle having a value of anywhere within this range.

The present disclosure provides a plurality (e.g., two or more) of nucleic acid templates immobilized to a support. In some embodiments, the immobilized plurality of nucleic acid templates have the same sequence or have different sequences. In some embodiments, individual nucleic acid template molecules in the plurality of nucleic acid templates are immobilized to a different site on the support. In some embodiments, two or more individual nucleic acid template molecules in the plurality of nucleic acid templates are immobilized to a site on the support. In some embodiments, the support comprises a plurality of sites arranged in an array. The term "array" refers to a support comprising a plurality of sites located at pre-determined locations on the support to form an array of sites. The sites can be discrete and separated by interstitial regions. In some embodiments, the pre-determined sites on the support can be arranged in one dimension in a row or a column, or arranged in two dimensions in rows and columns. In some embodiments, the plurality of pre-determined sites is arranged on the support in an organized fashion. In some embodiments, the plurality of pre-determined sites is arranged in any organized pattern, including rectilinear, hexagonal patterns, grid patterns, patterns having reflective symmetry, patterns having rotational symmetry, or the like. The pitch between different pairs of sites can be that same or can vary. In some embodiments, the support can have nucleic acid template molecules immobilized at a plurality of sites at a surface density of about $10^2$-$10^{15}$ sites per $mm^2$, or more, to form a nucleic acid template array. In some embodiments, the support comprises at least $10^2$ sites, at least $10^3$ sites, at least $10^4$ sites, at least $10^5$ sites, at least $10^6$ sites, at least $10^7$ sites, at least $10^8$ sites, at least $10^9$ sites, at least $10^{10}$ sites, at least $10^{11}$ sites, at least $10^{12}$ sites, at least $10^{13}$ sites, at least $10^{14}$ sites, at least $10^{15}$ sites, or more, where the sites are located at pre-determined locations on the support. In some embodiments, a plurality of pre-determined sites on the support (e.g., $10^2$-$10^{15}$ sites or more) are immobilized with nucleic acid templates to form a nucleic acid template array. In some embodiments, the nucleic acid templates that are immobilized at a plurality of pre-determined sites by hybridization to immobilized surface capture primers, or the nucleic acid templates are covalently attached to the surface capture primers. In some embodiments, the nucleic acid templates that are immobilized at a plurality of pre-determined sites, for example immobilized at $10^2$-$10^{15}$ sites or more. In some embodiments, the nucleic acid templates that are immobilized at a plurality of sites on the support comprise linear or circular nucleic acid template molecules or a mixture of both linear and circular molecules. In some embodiments, the immobilized nucleic acid templates are clonally-amplified to generate immobilized nucleic acid polonies at the plurality of pre-determined sites. In some embodiments, individual immobilized nucleic acid template molecules comprise one copy of a target sequence of interest, or comprise concatemers having two or more tandem copies of a target sequence of interest.

In some embodiments, a support comprising a plurality of sites located at random locations on the support is referred to herein as a support having randomly located sites thereon. The location of the randomly located sites on the support are not pre-determined. The plurality of randomly-located sites is arranged on the support in a disordered and/or unpredictable fashion. In some embodiments, the support comprises at least $10^2$ sites, at least $10^3$ sites, at least $10^4$ sites, at least $10^5$ sites, at least $10^6$ sites, at least $10^7$ sites, at least $10^8$ sites, at least $10^9$ sites, at least $10^{10}$ sites, at least $10^{11}$ sites, at least $10^{12}$ sites, at least $10^{13}$ sites, at least $10^{14}$ sites, at least $10^{15}$ sites, or more, where the sites are randomly located on the support. In some embodiments, a plurality of randomly located sites on the support (e.g., $10^2$-$10^{15}$ sites or more) are immobilized with nucleic acid templates to form a support immobilized with nucleic acid templates. In some embodiments, the nucleic acid templates that are immobilized at a plurality of randomly located sites by hybridization to immobilized surface capture primers, or the nucleic acid templates are covalently attached to the surface capture primer. In some embodiments, the nucleic acid templates that are immobilized at a plurality of randomly located sites, for example immobilized at $10^2$-$10^{15}$ sites or more. In some embodiments, the nucleic acid templates that are immobilized at a plurality of sites on the support comprise nucleic acid template molecules may include the nucleic acid template embodiments, including any of the potential features listed above, in some embodiments, the immobilized nucleic acid templates are clonally-amplified to generate immobilized nucleic acid polonies at the plurality of randomly located sites.

In some embodiments, with respect to nucleic acid template molecules immobilized to pre-determined or random sites on the support, the plurality of immobilized nucleic acid template molecules on the support are in fluid communication with each other to permit flowing a solution of reagents (e.g., enzymes including polymerases, multivalent molecules, nucleotides, divalent cations and/or buffers and the like) onto the support so that the plurality of immobilized nucleic acid template molecules on the support can be reacted with the reagents in a massively parallel manner. In some embodiments, the fluid communication of the plurality of immobilized nucleic acid template molecules can be used to conduct nucleotide binding assays and/or conduct nucleotide polymerization reactions (e.g., primer extension or sequencing) on the plurality of immobilized nucleic acid template molecules, and to conduct detection and imaging for massively parallel sequencing. In some embodiments, the term "immobilized" and related terms refer to nucleic acid molecules or enzymes (e.g., polymerases) that are attached to the support at pre-determined or random locations, where the nucleic acid molecules or enzymes are attached directly to a support through covalent bond or non-covalent interaction, or the nucleic acid molecules or enzymes are attached to a coating on the support.

As used herein, the term "sequencing" and its variants comprise obtaining sequence information from a nucleic acid strand, typically by determining the identity of at least some nucleotides (including their nucleobase components) within the nucleic acid template molecule. While in some embodiments, "sequencing" a given region of a nucleic acid molecule includes identifying each and every nucleotide within the region that is sequenced, in some embodiments "sequencing" comprises methods whereby the identity of only some of the nucleotides in the region is determined, while the identity of some nucleotides remains undetermined or incorrectly determined. Any suitable method of sequencing may be used. In an exemplary embodiment, sequencing can include label-free or ion-based sequencing methods. In some embodiments, sequencing can include labeled or dye-containing nucleotide or fluorescent based nucleotide sequencing methods. In some embodiments, sequencing can include polony-based sequencing or bridge sequencing methods. In some embodiments, sequencing includes massively parallel sequencing platforms that employ sequence-by-synthesis, sequence-by-hybridization or sequence-by-binding procedures. Examples of massively parallel sequence-by-synthesis procedures include polony sequencing, pyrosequencing (e.g., from 454 Life Sciences; U.S. Pat. Nos. 7,211,390, 7,244,559 and 7,264,929), chain-terminator sequencing (e.g., from Illumina; U.S. Pat. No. 7,566,537; Bentley 2006 Current Opinion Genetics and Development 16:545-552; and Bentley, et al., 2008 Nature 456:53-59, ion-sensitive sequencing (e.g., from Ion Torrent), probe-anchor ligation sequencing (e.g., Complete Genomics), DNA nanoball sequencing, nanopore DNA sequencing. Examples of single molecule sequencing include Heliscope single molecule sequencing, and single molecule real time (SMRT) sequencing. An example of sequence-by-hybridization includes SOLiD sequencing (e.g., from Life Technologies; WO 2006/084132). An example of sequence-by-binding includes Omniome sequencing (e.g., U.S. Pat. No. 10,246,744).

Engineered Polymerases

The present disclosure provides compositions comprising mutant polymerases having amino acid substitutions and/or truncated amino acid sequences, nucleic acids encoding the mutant polymerases, and systems and kits comprising mutant polymerases. Further provided herein are methods using the mutant polymerases, including methods for binding a nucleic acid duplex, binding a complementary nucleotide or binding a multivalent molecule having a complementary nucleotide unit, incorporating a complementary nucleotide or incorporating a complementary nucleotide unit, extending a primer, and nucleic acid sequencing, where the methods employ any of the mutant polymerases described herein. The mutant polymerases are engineered to exhibit desirable characteristics including increased incorporation of nucleotide analogs compared to a wild type polymerase. In one embodiment, the mutant polymerases comprise polypeptides, or fragments thereof, derived from directed evolution of recently identified novel B-family and A-family polymerases, where the mutant polymerases exhibit improvements in their specificity while maintaining high discrimination for the correct Watson-crick base-pairing. One exemplary polymerase enzyme originates from the Candidatus altiarchaeales archaeon species (e.g., SEQ ID NOS: 1 or 391), which was first identified in 2018. This enzyme contains less than 42% sequence identity to 9° N, Pfu, VENT, DEEP VENT and *Pyrococcus abyssi*, indicating extreme evolutionary divergence, which may be further evidenced by the fact that, while 9° N, Pfu, VENT, DEEP VENT and *Pyrococcus abyssi* polymerases possess thermostability at a high temperature (e.g., >95° C.), the Candidatus altiarchaeales archaeon polymerase possesses thermostability at a lower temperature (e.g., <75° C.) with an optimal catalytic temperature of about 68° C. Another exemplary polymerase enzyme that exhibits activity at temperature lower than 75° C. originates from *Geobacillus stearothermophilus* (e.g., SEQ ID NO: 275). The Candidatus altiarchaeales archaeon polymerase exhibits nucleotide binding and incorporation activity at a temperature range of about 25-50° C., or about 45-75° C., or about 65-75° C. The Candidatus altiarchaeales archaeon polymerase exhibits optimal nucleotide binding and incorporation activity at a temperature range of about 65-75° C. The Candidatus altiarchaeales archaeon polymerase is a moderately thermostable polymerase (e.g., mesothermal polymerase). Engineered polymerases having Candidatus altiarchaeales archaeon sequence backbone with one or more mutations can be used for conducting nucleotide binding, nucleotide unit binding, nucleotide incorporation, nucleotide unit incorporation and/or nucleic acid sequencing reactions at a temperature range of about 25-50° C., or about 45-75° C., or about 50-65° C., or about 50-60° C. Thermostable polymerases, such as for example 9° N, Pfu, VENT, DEEP VENT and *Pyrococcus abyssi* polymerases, are suitable for use in a PCR reaction where typical cycling steps are conducted at temperatures that exceed 90-95° C. or higher temperatures. One skilled in the art will appreciate that the thermostable polymerases described herein may not be suitable for use in a nucleotide binding, nucleotide incorporation, and/or nucleic acid sequencing reactions, conducted at lower temperature ranges such as for example about 25-50° C., or about 45-75° C.

Polymerases variously comprise DNA polymerases, RNA polymerases, template-independent polymerases, reverse transcriptases, or other enzymes capable of catalyzing nucleotide incorporation. Archaeal polymerases are often derived from thermophilic organisms, and thus can represent classes of thermostable or thermotolerant enzymes. Therefore, polypeptide backbones derived from archaeal polymerases provide desirable protein engineering targets to further enhance reversible terminator nucleotide (removable chemical groups which prevent nucleic acid extension) incorporation for applications that may be improved by the application of enzymes with enhanced thermostability or otherwise enhanced resistance to degradation such as by repeated exposure to high temperatures, changes in buffer conditions, etc.

We made the surprising discovery that engineered polymerases having Candidatus altiarchaeales archaeon sequence backbone and comprising one or more mutations exhibit enhanced incorporation rate of nucleotide analogs compared to wild type polymerases. Compared to wild type Candidatus altiarchaeales archaeon polymerase, some of the engineered polymerases exhibited one or more desirable characteristics, including increased binding affinity to nucleotide analogs having a 3' chain terminating group, improved ability to incorporate a dATP nucleotide opposite a uracil-containing template molecule (e.g., uracil-tolerant mutant polymerases), improved ability to bind complementary nucleotide units of multivalent molecules, and increased thermal stability up to approximately 75° C. We also demonstrate that engineered polymerases based on *Geobacillus stearothermophilus* backbone (e.g., Bst polymerase) and comprising mutant sequences exhibit improved incorporation of nucleotide analogs.

The present disclosure provides engineered polymerase that are useful for conducting any nucleic acid sequencing method that employs labeled or non-labeled chain terminating nucleotides, where the chain terminating nucleotides include a 3'-O-azido group (or 3'-O-methylazido group) or any other type of bulky blocking group at the sugar 3' position. For example, the engineered polymerases can be used to conduct sequencing-by-avidity methods (SBA) using labeled multivalent molecules and non-labeled chain terminating nucleotides. Additionally, the engineered polymerases can be used for conducting sequencing-by-synthesis (SBS) methods which employ labeled chain-terminating nucleotides, and for conducting sequencing-by-binding methods (SBB) which employ non-labeled chain-terminating nucleotides.

Sequencing-by-avidity (SBA) of DNA ideally requires (a) the detection of the n+1 base and requires 2 or more copies of target nucleic acid sequence, two or more primer nucleic acid molecules that are complementary to one or more regions of said target nucleic acid sequence and two more polymerases contacting said composition with a multivalent molecule (e.g., a polymer-nucleotide conjugate) under conditions sufficient to allow a multivalent binding complex to be formed between said polymer-nucleotide conjugate and said two or more copies of said target nucleic acid sequence in said composition of wherein the polymer-nucleotide conjugate comprises two or more nucleotide moieties; the detection substrates is subsequently washed away and (b) to ensure only a single incorporation occurs, a structural modification ('blocking group') of the an unlabeled nucleotides is required to ensure a single nucleotide incorporation but which then prevents any further nucleotide incorporation into the polynucleotide chain. The blocking group must then be removable, under reaction conditions which do not interfere with the integrity of the DNA being sequenced. The sequencing cycle can then continue with the N+1 detection of the next multivalent polymerase-conjugate-DNA complex and so on. In order to be of practical use, the avidity step requires both (a) a stable substrate to persist for long enough to image for >30 s and (b) a stepping step whereby the entire process should consist of high yielding, highly specific chemical and enzymatic steps to facilitate multiple cycles of sequencing.

Sequencing-by-synthesis (SBS) of DNA ideally requires the controlled (i.e. one at a time) incorporation of the correct complementary nucleotide opposite the oligonucleotide being sequenced. This allows for accurate sequencing by adding nucleotides in multiple cycles as each nucleotide residue is sequenced one at a time, thus preventing an uncontrolled series of incorporations occurring. The incorporated nucleotide is read using an appropriate label attached thereto before removal of the label moiety and the subsequent next round of sequencing. In order to ensure only a single incorporation occurs, a structural modification ('blocking group') of the sequencing nucleotides is required to ensure a single nucleotide incorporation but which then prevents any further nucleotide incorporation into the polynucleotide chain. The blocking group must then be removable, under reaction conditions which do not interfere with the integrity of the DNA being sequenced. The sequencing cycle can then continue with the incorporation of the next blocked, labelled nucleotide. In order to be of practical use, the entire process should consist of high yielding, highly specific chemical and enzymatic steps to facilitate multiple cycles of sequencing.

Sequencing-by-binding (SBB) requires method for sequencing a nucleic acid that includes the steps of (a) sequentially contacting a primed template nucleic acid with at least two separate mixtures under ternary complex stabilizing conditions, wherein the at least two separate mixtures each include a polymerase and a nucleotide, whereby the sequentially contacting results in the primed template nucleic acid being contacted, under the ternary complex stabilizing conditions, with nucleotide cognates for first, second and third base type base types in the template; (b) examining the at least two separate mixtures to determine whether a ternary complex formed; and (c) identifying the next correct nucleotide for the primed template nucleic acid molecule, wherein the next correct nucleotide is identified as a cognate of the first, second or third base type if ternary complex is detected in step (b), and wherein the next correct nucleotide is imputed to be a nucleotide cognate of a fourth base type based on the absence of a ternary complex in step (b); (d) adding a next correct nucleotide to the primer of the primed template nucleic acid after step (b), thereby producing an extended primer; and (e) repeating steps (a) through (d) for the primed template nucleic acid that comprises the extended primer.

Polypeptides described herein include but are not limited to polypeptides possessing enzymatic activity, such as polymerase activity, and are often described as families. Often, polymerases are DNA polymerases, RNA polymerases, template-independent polymerases, reverse transcriptases, or other enzymes capable of nucleotide binding and nucleotide incorporation (e.g., primer extension). Many DNA polymerases are known in the art, and such enzymes in some instances are mutated to generate the compositions described herein. Members of the DNA polymerase family are often defined in terms of polymerase activity, active site structure, domain homology/function, or sequence homology to other known DNA polymerase family members. For example, DNA polymerases include but are not limited to *E. coli* DNA polymerase I, *E. coli* DNA polymerase II, or other members of the DNA polymerase family. Known thermostable DNA polymerases include Taq polymerase, Pfu polymerase, and 9° N polymerase or other members of the DNA polymerase family. Wild-type DNA polymerases are or may be obtained from any number of origins, such as eukaryotic, prokaryotic, or viral origins, and in some embodiments for purposes of the present disclosure, from archaeal origins. In some embodiments, polymerases comprising amino acid sequences of any of SEQ ID NOS: 1-274 and 288-375 and 385-397 are members of a DNA polymerase family.

Further provided herein are polypeptides comprising a sequence that has at least 85% identity with SEQ ID NOS: 1 or 391 and at least one mutation at positions 403, 405, 406, 414, 415, 416, 417, 418, 468, 493, 495, 499, 501, 502, 507, 515, 529 and/or 567 of a polypeptide sequence numbered according to the residues in SEQ ID NOS: 1 or 391. In some cases, a polypeptide described herein comprises a sequence that has at least 70%, 75%, 80%, 85%, 90%, 91%, 92%, 93%, 94%, 95%, 96%, 97%, 98%, 99%, 99.1%, 99.2%, 99.3%, 99.4%, 99.5%, 99.6%, 99.7%, or 99.8% identity with SEQ ID NOS: 1 or 391. In some cases, a polypeptide described herein comprises a sequence that has at least 70%, 75%, 80%, 85%, 90%, 91%, 92%, 93%, 94%, 95%, 96%, 97%, 98%, 99%, 99.1%, 99.2%, 99.3%, 99.4%, 99.5%, 99.6%, 99.7%, or 99.8% identity with SEQ ID NOS: 1 or 391 and at least one mutation at positions 403, 405, 406, 414, 415, 416, 417, 418, 468, 493, 495, 499, 501, 502, 507, 515, 529 and/or 567 according to the numbering of SEQ ID NO: 1. In some embodiments, a polypeptide is disclosed herein that has at least 70%, 75%, 80%, 85%, 90%, 91%, 92%, 93%, 94%, 95%, 96%, 97%, 98%, 99%, 99.1%, 99.2%, 99.3%, 99.4%, 99.5%, 99.6%, 99.7%, or 99.8% identity with any of SEQ ID NOS: 1 or 2-268 or 288-375 or 385-397 and at least one mutation at a position analogous to one or more of positions 403, 405, 406, 414, 415, 416, 417, 418, 468, 493, 495, 499, 501, 502, 507, 515, 529 and/or 567 of SEQ ID NOS: 1, 393 or 391.

Further provided herein are polypeptides comprising a sequence that has at least 85% identity with SEQ ID NOS: 1 or 391 and at least one mutation at positions G403, H405, D406, R414, S415, L416, Y417, P418, R468, A493, K495, N499, M501, Y502, F507, R515, I529 and/or N567 of a polypeptide sequence numbered according to the residues in SEQ ID NOS: 1 or 391. In some cases, a polypeptide described herein comprises a sequence that has at least 70%, 75%, 80%, 85%, 90%, 91%, 92%, 93%, 94%, 95%, 96%, 97%, 98%, 99%, 99.1%, 99.2%, 99.3%, 99.4%, 99.5%, 99.6%, 99.7%, or 99.8% identity with SEQ ID NOS: 1 or 391. In some cases, this polypeptide also has at least one mutation at positions G403, H405, D406, R414, S415, L416, Y417, P418, R468, A493, K495, N499, M501, Y502, F507, R515, 1529 and/or N567 according to the numbering of SEQ ID NOS: 1, 393 or 391. In some embodiments, a polypeptide is disclosed herein that has at least 70%, 75%, 80%, 85%, 90%, 91%, 92%, 93%, 94%, 95%, 96%, 97%, 98%, 99%, 99.1%, 99.2%, 99.3%, 99.4%, 99.5%, 99.6%, 99.7%, or 99.8% identity with SEQ ID NOS: 1 or 2-268 or 288-375 or 385-397 and at least one mutation at a position analogous to one or more of positions G403, H405, D406, R414, 415, L416, Y417, P418, R468, A493, K495, N499, M501, Y502, F507, R515, I529 and/or N567 of SEQ ID NOS: 1 or 391. In some embodiments, the mutant polypeptide further comprises at least one mutation at position(s) D9, Y10, I11, E14, E27, F37, M41, H48, P45, L50, K51, Q54, K58, K61, I63, I68, E73, D75, E77, M84, Q87, V91, G96, E102, K105, V107, A115, E116, L124, P126, N132, M142, R170, E179, D191, E205, K225, V239, R256, I272, E291, D305, E308, E310, E328, I343, T344, S372, E434, Y448, V465, R467, G474, N480, R483, D488, A498, S500, M501, Y502, R509, E516, S520, K538, F539, D560, V564, M565, A568, E569, D573, K574, S577, E578, E581, M583, K610, T618, D636, N657, T675, K682, V689, E700, N705, 5717, E730, S746, E758, K762, G763, L764, G765, K766, Q767 and/or F773 of a polypeptide sequence numbered according to the amino acid residues in SEQ ID NO: 1, 393 or 391.

The present disclosure provides compositions and methods comprising mutant polypeptides relating to polymerase enzymes that exhibit increased capacity for binding and discrimination of nucleotide analogs, and improved incorporation of nucleotide analogs compared to a wild type polymerase. The nucleotide analogs include for example nucleotides comprising a chain terminating group attached to the sugar 2' or 3' position. The chain terminating group comprises an azide, azido or azidomethyl group, or another type of chain terminating group. The engineered DNA polymerases exhibit increased incorporation rate of nucleotide analogs, compared to a wild type polymerase having the amino acid sequence of SEQ ID NO: 1 or 391. The data shown in Table 1 (FIG. 3-1 through FIG. 3-8) provide numerous exemplary mutant polymerases that exhibit increased incorporation rate of nucleotide analogs.

The present disclosure provides compositions and methods comprising mutant polymerase enzymes having increased thermal stability compared to a wild type polymerase having the amino acid sequence of SEQ ID NO: 1 or 391.

The present disclosure provides compositions and methods comprising mutant polymerase enzymes that can be used for sequencing a uracil-containing nucleic acid template molecule. The mutant polymerases can exhibit uracil-tolerance having increased ability to incorporate dATP into the 3' end of a nucleic acid primer at a position that is opposite a uracil base in a nucleic acid template molecule. The mutant polymerases may also be capable of binding an adenine-bearing nucleotide unit of a multivalent molecule at a position that is opposite a uracil base in the nucleic acid template molecule. Exemplary mutant polymerases that exhibit uracil-tolerance comprise the amino acid sequence of any one of SEQ ID NOS: 361, 362, 363, 364, 366, 367, 374 or 375, or any of SEQ ID NOS: 385-397.

Mutations in the polymerases described herein variously comprise one or more changes to amino acid residues present in the polypeptide. Additions, substitutions, or deletions are all examples of mutations that are used to generate mutant polypeptides. Substitutions in some embodiments comprise the exchange of one amino acid for an alternative amino acid, and such alternative amino acids differ from the original amino acid with regard to size, shape, conformation, or chemical structure. Mutations in some embodiments are conservative or non-conservative. Conservative mutations comprise the substitution of an amino acid with an amino acid that possesses similar chemical properties. Additions often comprise the insertion of one or more amino acids at the N-terminal, C-terminal, or internal positions of the polypeptide. In some cases, additions comprise fusion polypeptides, wherein one or more additional polypeptides is connected to the polypeptide. Such additional polypeptides in some embodiments comprise domains with additional activity, or sequences with additional function (e.g., improve expression, aid purification, improve solubility, attach to a solid support, or other function). Often a polypeptide described herein comprises one or more non-amino acid groups. Fusion polypeptides optionally comprise an amino acid or other chemical linker that connects the one or more proteins. Any number of mutations can be introduced into a polypeptide or portion of a polypeptide described herein such as 1, 2, 3, 4, 5, 6, 7, 8, 9, 10, 20, 50, or more than 50 mutations.

In some embodiments, entire domains (portions of the polypeptide with a defined function) are added, deleted or substituted with domains from other polypeptides. Exemplary domains include DNA/RNA binding domains, nucleotide binding domains, nuclease domains, subcellular localization domains such as nuclear localization domains, or other domains. In some embodiments, the methods and compositions of the present disclosure comprise the attachment of a domain serving as a spacer or label, and/or providing for the attachment of a linker such as a SNAP tag, an avidin moiety, a streptavidin moiety, an epitope tag, a fluorescent protein, an affinity tag, a metal binding (i.e., a His6 (SEQ ID NO: 398) or polyhistidine tag) or the like. In some embodiments, one or more mutations are present in a catalytic site or binding domain. For example, a polypeptide comprises a nucleic acid binding domain as disclosed in SEQ ID NO: 1. A domain in some cases comprises a DNA or RNA binding site, for example comprising residues at positions 354-773, or alternatively, residues 249-253, 392-396, 598-601, 613-615, 673-676, and/or 681-683 of SEQ ID NO: 1. Such sites may be found in analogous positions after alignment of other sequences to SEQ ID NO: 1 (e.g., see FIG. 7 through FIG. 7-2, FIG. 8-1 through FIG. 8-3, FIG. 9-1 through FIG. 9-2, FIG. 10-1 through FIG. 10-2, FIG. 11-1 through FIG. 11-2, FIG. 12-1 through FIG. 12-2, and FIG. 13-1 through FIG. 13-2). In some embodiments, a domain comprises a polymerase domain comprising residues at positions 1-135, 136-347, 348-454, 455-504, 505-624, or 625-773 of SEQ ID NO: 1, or positional equivalents thereof (e.g., see Table 4 at FIGS. 6-1 through FIG. 6-3, and FIG. 7-1 through FIG. 7-2, FIG. 8-1 through FIG. 8-3, FIG. 9-1 through FIG. 9-2, FIG. 10-1 through FIG. 10-2, FIG. 11-1 through FIG. 11-2, FIG. 12-1 through FIG. 12-2, and FIG. 13-1 through FIG. 13-2). In some cases, a polypeptide comprises an active site. The active site of a polypeptide may comprise residues D412, D547, and/or D549 of SEQ ID NO: 1 or positional equivalents thereof (e.g., see Table 4 at FIG. 6-1 through FIG. 6-3, and FIGS. 7-13). Such sites are often found at analogous positions in other domains (e.g., identified by aligning the two or more sequences for comparison), and polypeptides that comprise such domains are consistent with methods and compositions described herein.

As used herein, the term "surrounding" an amino acid residue or sequence position has its ordinary meaning in the art, including and incorporating modifications such as substitutions, deletions, insertions, or post-translational modifications at residues from 1, 2, 3, 4, 5, 6, 7, 8, 9, 10, 11, or 12 or more residues distant from the named residue, i.e., N-terminal or C-terminal from the named residue. In some contexts, a residue greater than 12 residues or sequence positions N or C terminal from the named residue can be considered "surrounding" a named residue based on the sequence or structural (i.e., 3-dimensional) context as would be understood by one of ordinary skill in the art.

It is understood that substitutions or modifications of the residues described herein also may incorporate or may include nonstandard amino acids as are known in the art, including but not limited to hydroxyproline, N-formylmethionine, selenomethionine, selenocysteine, phosphotyrosine, phosphohistidine, and the like. The mutations, modifications, truncations, substitutions and the like as described herein may be made by any method as is known in the art, particularly the art of molecular biology and/or protein engineering. Such methods may include site directed mutagenesis using mutagenic and/or partially degenerate primers, in vitro gene assembly, gene editing (such as by CRISPR or related methods) and the like. The mutant or engineered proteins described herein may additionally be expressed, isolated, and/or purified by any such means as is known in the art. Relevant methods are described in: Green, M. and Sambrook, J., Molecular Cloning: A Laboratory Manual (Fourth Edition) which is hereby incorporated by reference in its entirety and especially with respect to its disclosure of methods for modifying, transferring, and expressing, recombinant, modified, and engineered gene sequences as well as extracting, isolating, and/or purifying engineered proteins.

The polypeptides disclosed herein have been shown to function as nucleotide polymerases that exhibit higher thermostability, higher rates of incorporation of 3'-O-azidomethyl derivatized nucleosides compared to wild type enzymes and/or increased uracil-tolerance. The polypeptides disclosed herein may be used for the elongation of a nucleic acid during replication or synthesis, or may be trapped at the site of nucleotide addition by, for example, use of a non-incorporable or blocked nucleotide, or can be used under conditions in which a required salt or cofactor is absent. The polypeptides disclosed herein may be utilized, for example, in polynucleotides sequencing applications such as, for example, sequencing by synthesis and sequencing by binding applications.

The present disclosure provides engineered DNA polymerases comprising the amino acid sequence backbone of a family-B polymerase which typically include replicative polymerases that exhibit improved incorporation of nucleotide analogs. Examples of family-B type polymerases include family-B archaeal DNA polymerases and Phi29 polymerase. In some embodiments, engineered DNA polymerases comprise family-B archaeal DNA polymerases which can be selected from Thermococcus, *Pyrococcus*, Methanococcus, or Candidatus. In some embodiments, engineered DNA polymerases comprise the amino acid sequence backbone from Candidatus Altiarchaeales archaeon DNA polymerase, 9° N polymerase (including THERMINATOR polymerase), VENT polymerase, DEEP VENT polymerase, Pfu polymerase, *Pyrococcus abyssi* polymerase, or RB69 polymerase. In some embodiments, engineered DNA polymerases can be based on the amino acid sequence backbone of a family-A type polymerase, including *Geobacillus* (e.g., *Geobacillus stearothermophilus*).

Engineered DNA polymerases can be designed and prepared by introducing one or more mutations into the amino acid sequence of a DNA polymerase of interest (e.g., wild type or mutant polymerases) and the resulting phenotype of the engineered polymerase can be determined. Any one or any combination of two or more mutation sites can be transferred from one type of polymerase to a positionally equivalent site in a second type of polymerase. For example, any one or any combination of two or more mutation sites from a Candidatus Altiarchaeales archaeon DNA polymerase can be introduced into a positionally equivalent site in a 9° N polymerase (including THERMINATOR polymerase), VENT polymerase, DEEP VENT polymerase, Pfu polymerase, *Pyrococcus abyssi* polymerase, and/or RB69 polymerase (e.g., see Table 4 at FIG. 6-1 through FIG. 6-3). The mutations include any one or any combination of two or more amino acid substitutions, insertions, deletions and/or truncations.

Functional equivalents of a residue comprise one or more amino acid residues that occupy a similar position in the sequence (e.g., sequence alignment) and/or three-dimensional structure of an enzyme (e.g., DNA polymerase), and performs substantially the same function as a known amino acid residue in a known enzyme. A functionally equivalent amino acid substitution includes one or more amino acid residues at a particular position in a basis polypeptide that has the same functional role in another polypeptide. A functionally equivalent amino acid substitution includes any one or any combination of conservative and/or non-conservative amino acid substitutions. Table 4 at FIG. 6 lists examples of amino acid residues at sites in a Candidatus Altiarchaeales archaeon DNA polymerase and functionally equivalent amino acid sites, for example in 9° N DNA polymerase (relative to SEQ ID NO: 280 or 281), THERMINATOR (relative to SEQ ID NO: 282), VENT DNA polymerase (relative to SEQ ID NO: 283), DEEP VENT DNA polymerase (relative to SEQ ID NO: 284), Pfu DNA polymerase (relative to SEQ ID NO: 285), *Pyrococcus abyssi* DNA polymerase (relative to SEQ ID NO: 286), and *Geobacillus stearothermophilus* DNA polymerase (relative to SEQ ID NO: 275).

Wild type polypeptide sequences are often starting points for protein or enzyme engineering to generate mutant polypeptides. In some embodiments, a mutant polypeptide differs from a wild-type polypeptide by at least one amino acid residue. Often a mutant polypeptide differs by at least one amino acid residue from the nearest wild-type polypeptide. In some embodiments, a mutant polypeptide differs from a wild-type polypeptide by at least two amino acid residues. In some embodiments, a mutant polypeptide differs from a wild-type polypeptide by at least three, four, five, or at least six amino acid residues. Often, a wild type sequence is the closest wild type sequence, identified by aligning the polypeptide comprising at least one mutation within a wild type sequence. In some embodiments, a wild type polypeptide sequence includes a sequence of a naturally-occurring polypeptide.

An amino acid substitution refers to replacing an amino acid residue at a selected position in a polypeptide with a different amino acid having a similar or different biochemical property, such as similar size, shape, conformation, chemical structure, charge and/or hydrophobicity. The amino acid substitution can be a conservative or non-conservative amino acid replacement. In some embodiments, an amino acid residue at a selected position in a polypeptide can be replaced with an amino acid having a polar side-chain. Examples of amino acids having a polar side-chain include arginine, asparagine, aspartic acid, glutamine, glutamic acid, histidine, lysine, serine and threonine. In some embodiments, an amino acid residue at a selected position in a polypeptide can be replaced with an amino acid having a nonpolar side-chain. Examples of amino acids having a nonpolar side-chain include alanine, cysteine, glycine, isoleucine, leucine, methionine, phenylalanine, prolific, tryptophan, tyrosine and valine. In some embodiments, an amino acid residue at a selected position in a polypeptide can be replaced with an amino acid having a hydrophobic side-chain. Examples of amino acids having a hydrophobic side-chain include glycine, alanine, valine, leucine, isoleucine, proline, phenylalanine, methionine, tyrosine and tryptophan. In some embodiments, an amino acid residue at a selected position in a polypeptide can be replaced with an amino acid having an uncharged side-chain. Examples of amino acids having an uncharged side-chain include glycine, serine, cysteine, asparagine, glutamine, tyrosine, and threonine. In some embodiments, an amino acid residue at a selected position in a polypeptide can be replaced with an amino acid having a positive charged side-chain. Examples of amino acids having a positive charged side-chain include arginine, histidine and lysine. In some embodiments, an amino acid residue at a selected position in a polypeptide can be replaced with an amino acid having a negative charged side-chain. Examples of amino acids having a negative charged side-chain include aspartic acid and glutamic acid.

The present disclosure provides mutant polymerases from Candidatus Altiarchaeales archaeon which comprise the backbone amino acid sequence of SEQ ID NO: 1 or 391 and having amino acid substitution mutations at one or more positions including F22, E26, V34, A35, K52, K58, 172, E79, M84, C104, I112, C130, E150, S162, C269, I272, R296, P335, G355, R359, E370, D381, G403, H405, D406, R414, S415, L416, Y417, P418, D439, S440, S443, C450, R468, K473, V489, Q492, A493, L494, K495, L496, N499, M501, Y502, F507, C514, R515, C517, T522, 1529, N567, E569, S577, R608, K610, L611, D622, K633, V651, D653, T660, A669, Q673, T683, R697, S717, R723, I750, L751 and/or E760. In some embodiments, the amino acid substitution mutations can also include the positions D141 and E143. In some embodiments, the mutant polymerases further comprise at least one mutation at positions D9, Y10, I11, E14, E27, F37, M41, P45, H48, L50, K51, Q54, K61, I63, I68, E73, D75, E77, M84, Q87, V91, G96, E102, K105, V107, A115, E116, L124, P126, N132, M142, R170, E179, D191, E205, K225, V239, R256, I272, E291, D305, E308, E310, E328, I343, T344, S372, E434, Y448, V465, R467, G474, N480, R483, D488, A498, S500, Y502, R509, E516, S520, K538, F539, D560, V564, M565, A568, D573, K574, E578, E581, M583, D680, T618, D636, N657, T675, E680, K682, V689, E700, N705, S717, E730, S746, E758, K762, G763, L764, G765, K766, Q767 and/or F773 of a polypeptide sequence numbered according to the residues in SEQ ID NO: 1, 393 or 391. In some embodiments, the mutant polymerases further comprise additional amino acids at the C-terminal end which comprise the sequence QGSYT (in single letter code) as shown in SEQ ID NO: 391.

In some embodiments, the mutant polymerases from Candidatus Altiarchaeales archaeon comprise the amino acid sequence of SEQ ID NO: 1 or 391 having any one or any combination of two or more amino acid substitutions including F22L, E26G, V34I, A35E, A35T, K58M, I72F, E79K, E79V, M84T, C104S, I112F, C130S, C130R, E150K, S162S, C269S, C269V, I272N, P335Q, G355S, E370D, D381Y, G403A, H405P, H405P, D406H, R414S, S415A, S415G, S415V, L416V, L416G, L416T, L416A, L416S, L416I, L416F, L416Y, L416M, Y417T, Y417S, Y417G, Y417A, Y417V, Y417I, P418S, P418G, P418V, P418C, P418K, P418I, P418T, P418A, D439S, S440N, S443N, C450S, R468A, R468V, R468S, R468K, R468H, R468G, K473A, V489I, Q492R, 492C, Q492F, Q492A, Q492G, A493V, A493S, L494V, K495G, K495A, K495Q, K495S, K495V, L496A, L496G, L496S, L496R, L496H, L496N, L496I, L496M, L496C, L496Y, N499G, N499A, N499S, N499V, M501I, Y502T, Y502V, Y502S, Y502R, Y502G, Y502N, Y502A, Y502Q, Y502P, Y502H, Y502F, F507S, C514S, R515L, R515W, R515Y, R515P, R515F, C517S, T522S, T522A, I529H, I529T, I529V, I529S, I529G, I529A, I529L, I529F, N567D, E569G, S577I, R608K, K610E, L611S, D622T, K633R, V651M, D653G, T660S, T683A, A669D, Q673I, R697G, S717G, R723H, I750V, L751M and/or E760G. In some embodiments, the amino acid substitution mutations can also include D141A and E143A. In some embodiments, the mutant polymerases from Candidatus Altiarchaeales archaeon further comprise any one or any combination of two or more amino acid substitutions (according to the numbering of SEQ ID NO: 1, 393 or 391) including D9N, Y10F, I11F, E14K, E14G, E27R, F37S, M41L, P45S, H48R, L50P, K51R, Q54L, K58R, K61E, I63T, I63V, I68V, E73K, D75N, E77G, M84L, Q87H, V91Q, G96S, E102R, K105R, V107I, A115V, E116G, L124Q, P126S, N132S, M142L, R170H, E179R, D191G, E205K, K225E, V239I, R256H, R256K, I272V, E291R, D305N, E308R, E310R, E328Q, I343V, T344I, S372N, E434R, Y448H, V465M, R467C, G474S, G474D, N480I, R483H, D488N, A498G, S500G, M501V, Y502F, R509H, E516G, S520N, S520G, K538R, F539Y, D560G, D560E, V564I, M565V, A568V, D573N, K574R, E578N, E581G, M583K, T618A, D636G, N657D, T675A, E680D, K682I, V689A, E700K, N705D, N705S, S717N, E730R, S746C, E758R, K762R, G763V, G763S, L764W, G765A, K766S, Q767K and/or F773S. In some embodiments, the mutant polymerases further comprise additional amino acids at the C-terminal end which comprise the sequence QGSYT (in single letter code) as shown in SEQ ID NO: 391.

Further described herein are segments, or portions of a larger polypeptide. Optionally, segments have catalytic activity such as nucleotide incorporation and nucleic acid extension activity, particularly in the context of a reverse transcriptase domain or polymerase domain as described herein. Described herein are polypeptides comprising any one of the segments derived from any subset of SEQ ID NOS: 1-391 and at least one additional residue at the N-terminus or C-terminus (e.g., +1 residue).

In some embodiments both the N and C terminus has at least an additional residue, two, three four five, six seven, eight, nine, ten 11, 12, 13, 14, 15, 16, 17, 18, 19, 20, 21, 22, 23, 24, 25, 26, 27, 28, 29, 30, 35, 40, 45, 50, 60, 70, 80, 90, 100, or more than 100 additional residues. For example, described herein are polypeptides comprising any of SEQ ID NOs: 1 and 2-391 (+1 residue), such as an adjacent N-terminal aspartic acid, an adjacent C-terminal arginine, or a combination thereof, or additional residues such as residues identified through an alignment of any of SEQ ID NOs: 1 and 2-391, to SEQ ID NO: 1, accounting for a single mutated residue or other residues contributed to a polypeptide comprising the SEQ ID NO: 1. Described herein are polypeptides comprising any of SEQ ID NOs: 1 and 2-391 (+1 residue), such as an adjacent N-terminal glutamine, an adjacent C-terminal histidine, or a combination thereof, or additional residues such as residues identified through an alignment of any of SEQ ID NOs: 1 and 2-391, to SEQ ID NO: 1, accounting for a single mutated residue, or other residues contributed to a polypeptide comprising the SEQ ID NO: 1. Described herein are polypeptides comprising any of SEQ ID NOs: 1 and 2-391 (+1 residue), such as an adjacent N-terminal valine, an adjacent C-terminal cysteine, or a combination thereof, or additional residues such as residues identified through an alignment of any of SEQ ID NOs: 1 and 2-391, to SEQ ID NO: 1, accounting for a single mutated residue, or other residues contributed to a polypeptide comprising the SEQ ID NO: 1. Described herein are polypeptides comprising any of SEQ ID NOs: 1 and 2-391 (+1 residue), such as an adjacent N-terminal threonine, an adjacent C-terminal cysteine, or a combination thereof, or additional residues such as residues identified through an alignment of any of SEQ ID NOs: 1 and 2-391, to SEQ ID NO: 1, accounting for a single mutated residue, or other residues contributed to a polypeptide comprising the SEQ ID NO: 1. Described herein are polypeptides comprising any of SEQ ID NOs: 1 and 2-391 (+1 residue), such as an adjacent N-terminal aspartic acid, an adjacent C-terminal leucine, or a combination thereof, or additional residues such as residues identified through an alignment of any of SEQ ID NOs: 1 and 2-391, to SEQ ID NO: 1, accounting for a single mutated residue, or other residues contributed to a polypeptide comprising the SEQ ID NO: 1. Described herein are polypeptides comprising any of SEQ ID NOs: 1 and 2-391 (+1 residue), such as an adjacent N-terminal aspartic acid, an adjacent C-terminal arginine, or a combination thereof, or additional residues such as residues identified through an alignment of any of SEQ ID NOs: 1 and 2-391 to SEQ ID NO: 1, accounting for a single mutated residue, or other residues contributed to a polypeptide comprising the SEQ ID NO: 1. Described herein are polypeptides comprising any of SEQ ID NOs: 1 and 2-391 (+1 residue), such as an adjacent N-terminal threonine, an adjacent C-terminal threonine, or a combination thereof, or additional residues such as residues identified through an alignment of any of SEQ ID NOs: 1 and 2-391 to SEQ ID NO: 1, accounting for a single mutated residue, or other residues contributed to a polypeptide comprising the SEQ ID NO: 1. Described herein are polypeptides comprising any of SEQ ID NOs: 1 and 2-391 (+1 residue), such as an adjacent N-terminal threonine, an adjacent C-terminal asparagine, or a combination thereof, or additional residues such as residues identified through an alignment of any of SEQ ID NOs: 1 and 2-391 to SEQ ID NO: 1, accounting for a single mutated residue, or other residues contributed to a polypeptide comprising the SEQ ID NO: 1. Described herein are polypeptides comprising any of SEQ ID NOs: 1 and 2-391 (+1 residue), such as an adjacent N-terminal threonine, an adjacent C-terminal serine, or a combination thereof, or additional residues such as residues identified through an alignment of any of SEQ ID NOs: 1 and 2-391 to SEQ ID NO: 1, accounting for a single mutated residue, or other residues contributed to a polypeptide comprising the SEQ ID NO: 1.

The present disclosure provides polymerases from *Geobacillus stearothermophilus* (e.g., SEQ ID NOS: 275-279). In some embodiments, the present disclosure provides one or more polypeptides having one or more mutations, such as substitutions, deletions, or insertions at or around positions 314, 332, 334, 368, 381, 385, 417, 434, 454, 471, 528, 601, 615, 635, 649, 654, 655, 656, 657, 658, 659, 665, 680, 682, 702, 706, 707, 710, 714, 758, 760, and/or 829 of SEQ ID NO: 275; or any combination thereof. Further provided herein are polypeptides comprising a sequence that has at least 85% identity with SEQ ID NO: 275 and at least one mutation at positions 314, 332, 334, 368, 381, 385, 417, 434, 454, 471, 528, 601, 615, 635, 649, 654, 655, 656, 657, 658, 659, 665, 680, 682, 702, 706, 707, 710, 714, 758, 760, and/or 829 of a polypeptide sequence numbered according to the residues in SEQ ID NO: 275. In some cases, a polypeptide described herein comprises a sequence that has at least 70%, 75%, 80%, 85%, 90%, 91%, 92%, 93%, 94%, 95%, 96%, 97%, 98%, 99%, 99.1%, 99.2%, 99.3%, 99.4%, 99.5%, 99.6%, 99.7%, or 99.8% identity with SEQ ID NO: 275. In some cases, a polypeptide described herein comprises a sequence that has at least 70%, 75%, 80%, 85%, 90%, 91%, 92%, 93%, 94%, 95%, 96%, 97%, 98%, 99%, 99.1%, 99.2%, 99.3%, 99.4%, 99.5%, 99.6%, 99.7%, or 99.8% identity with SEQ ID NO: 275 and at least one mutation at positions 314, 332, 334, 368, 381, 385, 417, 434, 454, 471, 528, 601, 615, 635, 649, 654, 655, 656, 657, 658, 659, 665, 680, 682, 702, 706, 707, 710, 714, 758, 760, and/or 829 according to the numbering of SEQ ID NO: 275.

In some embodiments, a polypeptide is disclosed herein that has at least 70%, 75%, 80%, 85%, 90%, 91%, 92%, 93%, 94%, 95%, 96%, 97%, 98%, 99%, 99.1%, 99.2%, 99.3%, 99.4%, 99.5%, 99.6%, 99.7%, or 99.8% identity with any of SEQ ID NOs: 1 and 256-279 and at least one mutation at a position analogous to one or more of positions 403, 405, 406, 414, 415, 416, 417, 418, 468, 493, 495, 499, 501, 502, 507, and/or 529 of SEQ ID NO: 1.

Further provided herein are polypeptides comprising a sequence that has at least 85% identity with SEQ ID NO: 275 and has at least one, or more, mutation at positions R615, Y654, S655, Q656, I657, E658, L659, D680, H682, R702, K706, A707, F710, Y714, H829, D314, I332, I334, K368, K381, I385, K417, K434, I454, D471, I528, K601, K635, I649, I665, K758, and/or K760 of a polypeptide sequence numbered according to the residues in SEQ ID NO: 275. In some cases, a polypeptide described herein comprises a sequence that has at least 70%, 75%, 80%, 85%, 90%, 91%, 92%, 93%, 94%, 95%, 96%, 97%, 98%, 99%, 99.1%, 99.2%, 99.3%, 99.4%, 99.5%, 99.6%, 99.7%, or 99.8% identity with SEQ ID NO: 275.

Exemplary polypeptide mutants described herein are listed in Table 1 (FIG. 3), Table 2 (FIG. 4-1 through FIG. 4-5) and Table 3 (FIG. 5-1 through FIG. 5-5). In some embodiments, a polypeptide described herein has a sequence that has at least 85% identity to SEQ ID NO: 1 or 391, and that further exhibits at least one of the mutations shown in Table 1 (FIG. 3-1 through FIG. 3-8), Table 2 (FIG. 4-1 through FIG. 4-5) or Table 3 (FIG. 5-1 through FIG. 5-5). In some embodiments, a polypeptide described herein has a sequence that has substantial identity to, or identity of at least 70%, 75%, 80%, 85%, 90%, 91%, 92%, 93%, 94%, 95%, 96%, 97%, 98%, 99%, 99.1%, 99.2%, 99.3%, 99.4%, 99.5%, 99.6%, 99.7%, 99.8% or greater sequence identity to any of SEQ ID NOs: 1 or 2-274 or 288-375 or 385-397, and that further exhibits at least one of the mutations shown in Table 1 (FIG. 3), Table 2 (FIG. 4-1 through FIG. 4-5) or Table 3 (FIG. 5-1 through FIG. 5-5). Additional polypeptides contemplated and disclosed herein comprise a DNA polymerase domain having at least one mutation at a position analogous to at least one of the positions in Table 1 (FIG. 3-1 through FIG. 3-8), Table 2 (FIG. 4-1 through FIG. 4-5) or Table 3 (FIG. 5-1 through FIG. 5-5), up to and including all of the positions indicated in Table 1 (FIG. 3-1 through FIG. 3-8), Table 2 (FIG. 4-1 through FIG. 4-5) or Table 3 (FIG. 5-1 through FIG. 5-5), in some cases to come to polypeptides having one or more of the mutations indicated in Table 1 (FIG. 3), Table 2 (FIG. 4-1 through FIG. 4-5) or Table 3 (FIG. 5-1 through FIG. 5-5) at a homologous position.

Tables 1, 2, and 3 represent the relative incorporation activities of various mutant variants relative to the wild type (SEQ ID NO: 1) DNA polymerase from Candidatus Altiarchaeales archaeon in different symbols. The symbol "0" represents that, based on experimental data, the mutant variants have insignificant incorporation activity or have no significant enhancement in incorporation activity compared to the wild type. The symbol "+" represents that, based on experimental data, the mutant variants have some degree of enhancement in incorporation activity compared to the wild type. The symbol "++" represents that, based on experimental data, the mutant variants have a high degree of enhancement in incorporation activity compared to the wild type.

In some embodiments, one or more mutant variants exhibit an average of the increased incorporation rate is at least 5 times more than an average incorporation rate of the wild-type polymerase having the amino acid sequence of SEQ ID NO: 1. In some embodiments, one or more mutant variants exhibit an average of the increased incorporation rate is at least 10 times more than an average incorporation rate of the wild-type polymerase having the amino acid sequence of SEQ ID NO: 1. In some embodiments, one or more mutant variants exhibit an average of the increased incorporation rate is at least 20 times more than an average incorporation rate of the wild-type polymerase having the amino acid sequence of SEQ ID NO: 1. In some embodiments, one or more mutant variants exhibit an average of the increased incorporation rate is at least 50 times more than an average incorporation rate of the wild-type polymerase having the amino acid sequence of SEQ ID NO: 1.

The present disclosure provides polymerases from Candidatus Altiarchaeales archaeon that are mutated in certain domains to improve binding and/or incorporating nucleotide analogs. For example, see SEQ ID NOS: 269-274.

For example, the N-terminal domain comprising the amino acid sequence of SEQ ID NO: 269 can be mutated at one or more positions Y10, K58, V91, C104 and/or C130. In some embodiments, the domain comprising the amino acid sequence of SEQ ID NO: 269 comprises any one or any combination of two or more amino acid substitutions Y10F, Y10A, Y10V, Y10I, Y10L, Y10M, Y10W, K58M, V91Q, V91A, V91I, V91L, V91M, V91F, V91Y, V91W, V91S, V91T, V91N, C104S, C130S and/or C130R.

The exonuclease domain comprising the amino acid sequence of SEQ ID NO: 270 can be mutated at one or more positions D141, E143, C269 and/or P335Q. In some embodiments, the domain comprising the amino acid sequence of SEQ ID NO: 270 comprises any one or any combination of two or more amino acid substitutions D141A, E143A, C269S and/or P335. In some embodiments, the amino acid substitution mutations can include D141A and E143A to knock-out the 3' to 5' exonuclease activity (e.g., proofreading activity).

In some embodiments, the palm (1) domain comprising the amino acid sequence of SEQ ID NO: 271 (e.g., a first palm domain) can be mutated at one or more positions G355, E370, D381, G403, H405, D406, R414, S415, L416, Y417, P418, D439, S440, S443 and/or C450. In some embodiments, the domain comprising the amino acid sequence of SEQ ID NO: 271 (e.g., a first palm domain) comprises any one or any combination of two or more amino acid substitutions G355S, E370, D381Y, G403A, H405P, H405S, D406H, R414S, S415A, L416V, L416G, L416T, L416A, L416S, L416I, L416F, L416Y, L416M, Y417T, Y417S, Y417G, Y417A, Y417V, Y417I, P418S, P418G, P418V, P418C, P418K, P418I, P418T, P418A, D439S, S440N, S443N and/or C450S.

In some embodiments, the fingers domain comprising the amino acid sequence of SEQ ID NO: 272 (e.g., finger domain) can be mutated at one or more positions R468, K473, V489, Q492, A493, L494, K495, N499, M501 and/or Y502. In some embodiments, the domain comprising the amino acid sequence of SEQ ID NO: 272 (e.g., finger domain) comprises any one or any combination of two or more amino acid substitutions R468A, R468V, R468S, R468K, R468H, R468G, K473A, V489I, Q492R, Q492C, Q492F, Q492A, Q492G, A493V, A493S, L494V, K495G, K495A, K495Q, K495S, K495V, N499G, N499A, N499S, N499V, M501I, Y502T, Y502V, Y502S, Y502R, Y502G, Y502N, Y502A, Y502Q, Y502P, Y502H and/or Y502F. In some embodiments, the domain comprising the amino acid sequence of SEQ ID NO: 272 (e.g., finger domain) further comprises any one or any combination of two or more amino acid substitutions G474S, G474D, N480I, R483H, D488N, A498G, S500G, M501V and/or Y502F.

In some embodiments, the palm (2) domain comprising the amino acid sequence of SEQ ID NO: 273 (e.g., second palm domain) can be mutated at one or more positions and/or F507, C514, R515, C517, I529, N567, E569, S577, R608, K610 and/or L611. In some embodiments, the domain comprising the amino acid sequence of SEQ ID NO: 273 (e.g., second palm domain) comprises any one or any combination of two or more amino acid substitutions F507S, C514S, R515L, R515W, R515Y, R515P, R515F, C517S, I529H, I529T, I529V, I529S, I529G, I529A, I529L, I529F, N567D, E569G, S577I, R608K, K610E, L611S and/or D622. In some embodiments, the domain comprising the amino acid sequence of SEQ ID NO: 273 (e.g., second palm domain) further comprises any one or any combination of two or more amino acid substitutions E516G, S520N, S520G, K538R, F539Y, D560G, D560E, V564I, M565V, A568V, D573N, K574R, E578N, E581G, M583K and/or D622T.

In some embodiments, the thumb domain comprising the amino acid sequence of SEQ ID NO: 274 (e.g., thumb domain) can be mutated at one or more positions V651, D653, A669, Q673, E680, R697, 5717, R723, I750 and/or E760. In some embodiments, the domain comprising the amino acid sequence of SEQ ID NO: 274 (e.g., thumb domain) comprises any one or any combination of two or more amino acid substitutions V651M, D653G, E680D, A669D, Q673I, R697G, S717G, R723H, I750V and/or E760G. In some embodiments, the domain comprising the amino acid sequence of SEQ ID NO: 274 (e.g., thumb domain) further comprises any one or any combination of two or more amino acid substitutions D636G, T675A, K682I, V689A, N705D, S717N, E730R, S746C and/or E758R.

The present disclosure provides polymerases from Candidatus Altiarchaeales archaeon that are mutated at two or more positions to increase the incorporation rate of nucleotide analogs. In some embodiments, mutant polymerases from Candidatus Altiarchaeales archaeon comprises the amino acid sequence of SEQ ID NO: 1 or 391 having one or more amino acid substitutions mutations which are selected from a group consisting of L416, Y417, P418, A493 and/or I529 (e.g., see Table 1 (FIG. 3-1 through FIG. 3-8), Table 2 (FIG. 4-1 through FIG. 4-5) or Table 3 (FIG. 5-1 through FIG. 5-5). In some embodiments, the amino acid substitution mutation at position L416 comprises a nonpolar amino acid or polar non-charged amino acid. In some embodiments, the amino acid substitution mutation at position L416 comprises valine, glycine, threonine, alanine, serine, isoleucine, leucine, phenylalanine, tyrosine or methionine. In some embodiments, the amino acid substitution mutation at position Y417 comprises a non-polar amino acid or a polar uncharged amino acid. In some embodiments, the amino acid substitution mutation at position Y417 comprises threonine, serine, glycine, alanine, valine, isoleucine or tyrosine. In some embodiments, the amino acid substitution mutation at position P418 comprises a polar uncharged amino acid, non-polar amino acid or a positively charged amino acid. In some embodiments, the amino acid substitution mutation at position P418 comprises serine, glycine, valine, cysteine, lysine, isoleucine, threonine or proline. In some embodiments, the amino acid substitution mutation at position A493 comprises a nonpolar amino acid or a polar uncharged amino acid. In some embodiments, the amino acid substitution mutation at position A493 comprises valine or serine. In some embodiments, the amino acid substitution mutation at position I529 comprises a positively charged amino acid, polar uncharged amino acid or nonpolar amino acid. In some embodiments, the amino acid substitution mutation at position I529 comprises histidine, threonine, valine, serine, glycine, alanine, leucine, phenylalanine. In some embodiments, the mutant polymerases from Candidatus Altiarchaeales archaeon comprises the amino acid sequence of SEQ ID NO: 1 or 391 having amino acid substitution mutations at positions L416S, Y417A, P418G, A493S and I529H. In some embodiments, the mutant polymerases from Candidatus Altiarchaeales archaeon comprises the amino acid sequence of SEQ ID NO: 1 having amino acid substitution mutations at positions L416F, Y417A, P418G, A493S and I529H. In some embodiments, the amino acid substitution mutations can also include D141A and E143A.

In some embodiments, a polypeptide according to the present disclosure may comprise a single point mutation (e.g., see Table 1 (FIG. 3-1 through FIG. 3-8), Table 2 (FIG. 4-1 through FIG. 4-5) or Table 3 (FIG. 5-1 through FIG. 5-5). In some embodiments, a single point mutation in SEQ ID NO: 1 or 391 may comprise one or more of G403A, H405P, H405S, D406H, R414S, S415A, S415G, S415V, L416V, L416G, L416T, L416A, L416S, L416I, L416L, Y417T, Y417S, Y417G, Y417A, Y417V, Y417I, P418S, P418G, P418V, P418C, P418K, P418I, P418T, R468A, R468V, R468S, R468K, R468H, R468G, A493V, K495G, K495A, K495Q, K495S, K495V, N499G, N499A, N499S, N499V, S500G, M501I, Y502T, Y502V, Y502S, Y502R, Y502G, Y502N, Y502A, Y502Q, Y502P, Y502H, Y502F, F507S, I529H, I529T, I529V, I529S, I529G, I529A, I529L, and/or I529F or any combination thereof. In some embodiments, a single point mutation in SEQ ID NO: 1 or 391 may comprise one or more of Y502V, Y502S, Y502Q, Y502P, Y502H, Y502G, Y502, Y502A, S415V, S415G, S415A, R468V, R468S, R468K, R468H, R468G, R468A, R414S, L416V, L416S, L416A, I529V, I529S, I529H, I529G, I529A, I529H or any combination thereof.

In some embodiments, a polypeptide according to the present disclosure may comprise an amino acid sequence of SEQ ID NO: 1 or 391 and comprising multiple mutations such as (e.g., see Table 1 (FIG. 3-1 through FIG. 3-8), Table 2 (FIG. 4-1 through FIG. 4-5) or Table 3 (FIG. 5-1 through FIG. 5-5), for example, two or more mutations of G403A, H405P, H405S, D406H, R414S, S415A, S415G, S415V, L416V, L416G, L416T, L416A, L416S, L416I, L416L, Y417T, Y417S, Y417G, Y417A, Y417V, Y417I, P418S, P418G, P418V, P418C, P418K, P418I, P418T, R468A, R468V, R468S, R468K, R468H, R468G, A493V, K495G, K495A, K495Q, K495S, K495V, N499G, N499A, N499S, N499V, M501I, Y502T, Y502V, Y502S, Y502R, Y502G, Y502N, Y502A, Y502Q, Y502P, Y502H, Y502F, F507S, I529H, I529T, I529V, I529S, I529G, I529A, I529L, and/or I529F, or any combination thereof.

In some embodiments, a polypeptide according to the present disclosure may comprise an amino acid sequence of SEQ ID NO: 1 or 391 and having double mutations (e.g., see Table 1 (FIG. 3-1 through FIG. 3-8), Table 2 (FIG. 4-1 through FIG. 4-5) or Table 3 (FIG. 5-1 through FIG. 5-5), including, for example, one or more of Y417V_P418V, Y417V_P418S, Y417V_P418A, Y417T_P418K, Y417S_P418S, Y417S_P418G, Y417S_P418A, Y417G_P418V, Y417G_P418S, Y417G_P418G, Y417G_P418C, Y417G_P418A, Y417A_P418V, Y417A_P418S, Y417A_P418G, Y417A_P418A, S415V_Y417S, S415V_Y417A, S415V_P418V, S415V_P418S, S415V_P418G, S415V_L416V, S415V_L416S, S415G_Y417V, S415G_Y417S, S415G_P418V, S415G_P418S, S415G_P418G, S415G_P418A, S415G_L416V, S415G_L416S, S415G_L416G, S415G_L416A, S415A_Y417G, S415A_Y417A, S415A_P418G, S415A_L416S, L416V_P418S, L416V_P418G, L416S_Y417G, L416S_Y417A, L416S_P418V, L416S_P418G, L416G_Y417G, L416G_Y417A, L416G_P418G, L416G_P418A, L416A_Y417S, L416A_P418S, L416A_P418G, and/or L416A_P418A or any combination thereof.

In some embodiments, a polypeptide according to the present disclosure may comprise an amino acid sequence of SEQ ID NO: 1 or 391 and having triple mutations. In some exemplary embodiments, triple mutations (e.g., see Table 1 (FIG. 3-1 through FIG. 3-8), Table 2 (FIG. 4-1 through FIG. 4-5) or Table 3 (FIG. 5-1 through FIG. 5-5) may comprise one or more of Y417V_P418V_Y502S, Y417V_P418G_Y502G, Y417V_P418A_Y502R, Y417S_P418V_Y502R, Y417S_P418G_Y502S, Y417G_P418G_Y502V, Y417G_P418A_Y502N, Y417G_P418A_Y502G, Y417A_P418S_Y502R, G403A_H405S_D406H, A493V_K495V_N499S, A493V_K495V_N499G, A493V_K495V_N499A, A493V_K495S_N499V, A493V_K495S_N499S, A493V_K495S_N499G, A493V_K495Q_N499V, A493V_K495Q_N499G, A493V_K495Q_N499A, A493V_K495G_N499V, A493V_K495G_N499S, A493V_K495G_N499G, A493V_K495G_N499A, A493V_K495A_N499G, A493V_K495A_N499A, A493V_K495S_N499G, L416A_Y417A_P418A, L416A_Y417A_P418G, L416A_Y417A_P418I, L416A_Y417S_P418A, L416A_Y417S_P418G, L416A_Y417S_P418S, L416G_Y417G_P418G, L416I_Y417A_P418G, L416I_Y417A_P418S, L416I_Y417G_P418A, L416I_Y417I_P418V, L416S_Y417A_P418G, L416S_Y417G_P418A, L416T_Y417A_P418A, L416T_Y417G_P418A, L416V_Y417A_P418A, L416V_Y417G_P418G, L416I_Y417S_P418S, and/or L416V_Y417V_P418G or any combination thereof.

In some embodiments, a polypeptide according to the present disclosure may comprise an amino acid sequence of SEQ ID NO: 1 or 391 and having quadruple mutations (e.g., see (FIG. 3-1 through FIG. 3-8), Table 2 (FIG. 4-1 through FIG. 4-5) or Table 3 (FIG. 5-1 through FIG. 5-5). In some exemplary embodiments, quadruple mutations may comprise one or more of H405P_A493V_K495G_N499A, A493V_K495S_N499A_Y502T, A493V_K495Q_N499G_F507S, A493V_K495G_N499G_M501I, L416A_Y417A_P418A_I529L, L416A_Y417A_P418A_I529H, L416A_Y417A_P418S_I529H, L416A_Y417G_P418A_I529H, L416A_Y417G_P418G_I529H, L416A_Y417G_P418S_I529H, L416G_Y417T_P418S_I529H, L416I_Y417A_P418A_I529L, L416I_Y417A_P418G_I529F, L416I_Y417A_P418S_I529H, L416I_Y417G_P418A_I529L, L416I_Y417S_P418G_I529H, L416L_Y417Y_P418P_I529H, L416S_Y417A_P418G_I529H, L416S_Y417A_P418G_I529F, L416S_Y417A_P418T_I529H, L416S_Y417G_P418G_I529H, L416S_Y417G_P418V_I529H, L416T_Y417A_P418A_I529H, L416T_Y417A_P418G_I529H, L416T_Y417G_P418A_I529H, L416V_Y417A_P418A_I529H, L416V_Y417A_P418G_I529S, L416V_Y417A_P418G_I529T, L416V_Y417A_P418G_I529H, L416V_Y417A_P418S_I529, L416V_Y417G_P418A_I529H, L416V_Y417G_P418G_I529H, L416V_Y417G_P418S_I529H, and/or L416V_Y417T_P418S_I529H or any combination thereof.

In some embodiments, the compositions and methods of the present disclosure comprise one or more mutations that may affect thermal stability of the enzyme, and/or the ability of the enzyme to accept modified substrates, such as 3' or 5' modified substrates as disclosed herein. In some embodiments, said mutation or mutations may comprise one or more substitutions, deletions, or insertions at, or at a position or location surrounding, one or more of positions 403, 405, 406, 414, 415, 416, 417, 418, 468, 493, 495, 499, 501, 502, 507, 515, 529 and/or 567 of SEQ ID NO: 1, 393 or 391, or any combination thereof, or homologs or orthologs thereof. In some embodiments, said mutation or mutations may comprise substitution of said residues with any of the 19 other natural amino acids (i.e., W, I, M, P, F, G, A, V, L, H, R, K, D, N, Y, C, S, T, or Q) or with non-natural amino acids as are known to those of skill in the art.

3' or 5' modified substrates as disclosed herein. In some embodiments, said mutation or mutations may comprise one or more substitutions, deletions, or insertions at, or at a position or location surrounding, position 403 of SEQ ID NO: 1, 393 or 391, or any combination thereof, or homologs or orthologs thereof. In some embodiments, said mutation or mutations may comprise substitution of said residues with any of the 20 natural amino acids (i.e., W, I, M, P, F, G, A, V, L, H, E, R, K, D, N, Y, C, S, T, or Q) or with non-natural amino acids as are known to those of skill in the art. In some embodiments, said mutation or mutations may comprise the substitution G403A. In some embodiments, said mutation or mutations may comprise one or more substitutions, deletions, or insertions at, or at a position or location surrounding, position 405 of SEQ ID NO: 1, 393 or 391, or any combination thereof, or homologs or orthologs thereof. In some embodiments, said mutation or mutations may comprise the substitution H405P or H405S. In some embodiments, said mutation or mutations may comprise one or more substitutions, deletions, or insertions at, or at a position or location surrounding, position 406 of SEQ ID NO: 1, 393 or 391, or any combination thereof, or homologs or orthologs thereof. In some embodiments, said mutation or mutations may comprise the substitution D406H. In some embodiments, said mutation or mutations may comprise one or more substitutions, deletions, or insertions at, or at a position or location surrounding, position 414 of SEQ ID NO: 1, 393 or 391, or any combination thereof, or homologs or orthologs thereof. In some embodiments, said mutation or mutations may comprise the substitution R414S. In some embodiments, said mutation or mutations may comprise one or more substitutions, deletions, or insertions at, or at a position or location surrounding, position 415 of SEQ ID NO: 1, 393 or 391, or any combination thereof, or homologs or orthologs thereof. In some embodiments, said mutation or mutations may comprise the substitution S415A, S415G or S415V. In some embodiments, said mutation or mutations may comprise one or more substitutions, deletions, or insertions at, or at a position or location surrounding, position 416 of SEQ ID NO: 1, 393 or 391, or any combination thereof, or homologs or orthologs thereof. In some embodiments, said mutation or mutations may comprise the substitution L416V, L416G, L416T, L416A, or L416S. In some embodiments, said mutation or mutations may comprise one or more substitutions, deletions, or insertions at, or at a position or location surrounding, position 417 of SEQ ID NO: 1, 393 or 391, or any combination thereof, or homologs or orthologs thereof. In some embodiments, said mutation or mutations may comprise the substitution Y417T, Y417S, Y417G, Y417A, Y417V, or Y417I. In some embodiments, said mutation or mutations may comprise one or more substitutions, deletions, or insertions at, or at a position or location surrounding, position 418 of SEQ ID NO: 1, 393 or 391, or any combination thereof, or homologs or orthologs thereof. In some embodiments, said mutation or mutations may comprise the substitution P418S, P418G, P418V, P418C, P418K, P418I, or P418T. In some embodiments, said mutation or mutations may comprise one or more substitutions, deletions, or insertions at, or at a position or location surrounding, position 468 of SEQ ID NO: 1, 393 or 391, or any combination thereof, or homologs or orthologs thereof. In some embodiments, said mutation or mutations may comprise the substitution R468A, R468V, R468S, R468K, R468H or R468G. In some embodiments, said mutation or mutations may comprise one or more substitutions, deletions, or insertions at, or at a position or location surrounding, position 493 of SEQ ID NO: 1, 393 or 391, or any combination thereof, or homologs or orthologs thereof. In some embodiments, said mutation or mutations may comprise the substitution A493V or A493S. In some embodiments, said mutation or mutations may comprise one or more substitutions, deletions, or insertions at, or at a position or location surrounding, position 495 of SEQ ID NO: 1, 393 or 391, or any combination thereof, or homologs or orthologs thereof. In some embodiments, said mutation or mutations may comprise the substitution K495G, K495A, K495Q, K495S, or K495V. In some embodiments, said mutation or mutations may comprise one or more substitutions, deletions, or insertions at, or at a position or location surrounding, position 499 of SEQ ID NO: 1, 393 or 391, or any combination thereof, or homologs or orthologs thereof. In some embodiments, said mutation or mutations may comprise the substitution N499G, N499A, N499S, or N499V. In some embodiments, said mutation or mutations may comprise one or more substitutions, deletions, or insertions at, or at a position or location surrounding, position 501 of SEQ ID NO: 1, 393 or 391, or any combination thereof, or homologs or orthologs thereof. In some embodiments, said mutation or mutations may comprise the substitution M501I. In some embodiments, said mutation or mutations may comprise one or more substitutions, deletions, or insertions at, or at a position or location surrounding, position 502 of SEQ ID NO: 1, 393 or 391, or any combination thereof, or homologs or orthologs thereof. In some embodiments, said mutation or mutations may comprise the substitution Y502T, Y502V, Y502S, Y502R, Y502G, Y502N, Y502A, Y502Q, Y502P, Y502H, or Y502F. In some embodiments, said mutation or mutations may comprise one or more substitutions, deletions, or insertions at, or at a position or location surrounding, position 507 of SEQ ID NO: 1, 393 or 391, or any combination thereof, or homologs or orthologs thereof. In some embodiments, said mutation or mutations may comprise the substitution F507S. In some embodiments, said mutation or mutations may comprise one or more substitutions, deletions, or insertions at, or at a position or location surrounding, position 515 of SEQ ID NO: 1, 393 or 391, or any combination thereof, or homologs or orthologs thereof. In some embodiments, said mutation or mutations may comprise the substitution R515L, R515W, R515Y, R515P or R515F. In some embodiments, said mutation or mutations may comprise one or more substitutions, deletions, or insertions at, or at a position or location surrounding, position 529 of SEQ ID NO: 1, 393 or 391, or any combination thereof, or homologs or orthologs thereof. In some embodiments, said mutation or mutations may comprise the substitution I529H, I529T, I529V, I529S, I529G, I529A, I529L, or I529F. In some embodiments, said mutation or mutations may comprise one or more substitutions, deletions, or insertions at, or at a position or location surrounding, position 567 of SEQ ID NO: 1, 393 or 391, or any combination thereof, or homologs or orthologs thereof. In some embodiments, said mutation or mutations may comprise the substitution N567D. In some embodiments, said mutation may be combined with one or more mutations at other positions, such as one or more substitutions, deletions, or insertions at, or at a position or location surrounding, any of positions 403, 405, 406, 414, 415, 416, 417, 418, 468, 493, 495, 499, 501, 502, 507, 515, 529 and/or 567 or any combination thereof. In some embodiments, the compositions and methods of the present disclosure comprise one or more mutations that may affect thermal stability of the enzyme, and/or the ability of the enzyme to accept modified substrates, such as 3' or 5' modified substrates as disclosed herein. In some embodiments, said mutation or mutations may comprise one or more substitutions, deletions, or insertions at, or at a position or location surrounding, position 405 of SEQ ID NO: 1, 393 or 391, or any combination thereof, or homologs or orthologs thereof. In some embodiments, said mutation or mutations may comprise substitution of said residues with any of the 20 natural amino acids (i.e., W, I, M, P, F, G, A, V, L, H, E, R, K, D, N, Y, C, S, T, or Q) or with non-natural amino acids as are known to those of skill in the art. In some embodiments, said mutation or mutations may comprise the substitution H405P or H405S. In some embodiments, said mutation may be combined with one or more mutations at other positions, such as one or more substitutions, deletions, or insertions at, or at a position or location surrounding, any of positions 403, 406, 414, 415, 416, 417, 418, 468, 493, 495, 499, 501, 502, 507, 515, 529 and/or 567 or any combination thereof.

In some embodiments, the compositions and methods of the present disclosure comprise one or more mutations that may affect thermal stability of the enzyme, and/or the ability of the enzyme to accept modified substrates, such as 3' or 5' modified substrates as disclosed herein. In some embodiments, said mutation or mutations may comprise one or more substitutions, deletions, or insertions at, or at a position or location surrounding, position 406 of SEQ ID NO: 1, 393 or 391, or any combination thereof, or homologs or orthologs thereof. In some embodiments, said mutation or mutations may comprise substitution of said residues with any of the 20 natural amino acids (i.e., W, I, M, P, F, G, A, V, L, H, E, R, K, D, N, Y, C, S, T, or Q) or with non-natural amino acids as are known to those of skill in the art. In some embodiments, said mutation or mutations may comprise the substitution D406H. In some embodiments, said mutation may be combined with one or more mutations at other positions, such as one or more substitutions, deletions, or insertions at, or at a position or location surrounding, any of positions 403, 405, 414, 415, 416, 417, 418, 468, 493, 495, 499, 501, 502, 507, 515, 529 and/or 567 or any combination thereof.

In some embodiments, the compositions and methods of the present disclosure comprise one or more mutations that may affect thermal stability of the enzyme, and/or the ability of the enzyme to accept modified substrates, such as 3' or 5' modified substrates as disclosed herein. In some embodiments, said mutation or mutations may comprise one or more substitutions, deletions, or insertions at, or at a position or location surrounding, position 414 of SEQ ID NO: 1, 393 or 391, or any combination thereof, or homologs or orthologs thereof. In some embodiments, said mutation or mutations may comprise substitution of said residues with any of the 20 natural amino acids (i.e., W, I, M, P, F, G, A, V, L, H, E, R, K, D, N, Y, C, S, T, or Q) or with non-natural amino acids as are known to those of skill in the art. In some embodiments, said mutation or mutations may comprise the substitution R414S. In some embodiments, said mutation may be combined with one or more mutations at other positions, such as one or more substitutions, deletions, or insertions at, or at a position or location surrounding, any of positions 403, 405, 406, 415, 416, 417, 418, 468, 493, 495, 499, 501, 502, 507, 515, 529 and/or 567 or any combination thereof.

In some embodiments, the compositions and methods of the present disclosure comprise one or more mutations that may affect thermal stability of the enzyme, and/or the ability of the enzyme to accept modified substrates, such as 3' or 5' modified substrates as disclosed herein. In some embodiments, said mutation or mutations may comprise one or more substitutions, deletions, or insertions at, or at a position or location surrounding, position 415 of SEQ ID NO: 1, 393 or 391, or any combination thereof, or homologs or orthologs thereof. In some embodiments, said mutation or mutations may comprise substitution of said residues with any of the 20 natural amino acids (i.e., W, I, M, P, F, G, A, V, L, H, E, R, K, D, N, Y, C, S, T, or Q) or with non-natural amino acids as are known to those of skill in the art. In some embodiments, said mutation or mutations may comprise the substitution S415A, S415G or S415V. In some embodiments, said mutation may be combined with one or more mutations at other positions, such as one or more substitutions, deletions, or insertions at, or at a position or location surrounding, any of positions 403, 405, 406, 414, 416, 417, 418, 468, 493, 495, 499, 501, 502, 507, 515, 529 and/or 567 or any combination thereof.

In some embodiments, the compositions and methods of the present disclosure comprise one or more mutations that may affect thermal stability of the enzyme, and/or the ability of the enzyme to accept modified substrates, such as 3' or 5' modified substrates as disclosed herein. In some embodiments, said mutation or mutations may comprise one or more substitutions, deletions, or insertions at, or at a position or location surrounding, position 416 of SEQ ID NO: 1, 393 or 391, or any combination thereof, or homologs or orthologs thereof. In some embodiments, said mutation or mutations may comprise substitution of said residues with any of the 20 natural amino acids (i.e., W, I, M, P, F, G, A, V, L, H, E, R, K, D, N, Y, C, S, T, or Q) or with non-natural amino acids as are known to those of skill in the art. In some embodiments, said mutation or mutations may comprise the substitution L416V, L416G, L416T, L416A, L416S, L416I or L416L. In some embodiments, said mutation may be combined with one or more mutations at other positions, such as one or more substitutions, deletions, or insertions at, or at a position or location surrounding, any of positions 403, 405, 406, 414, 415, 417, 418, 468, 493, 495, 499, 501, 502, 507, 515, 529 and/or 567 or any combination thereof.

In some embodiments, the compositions and methods of the present disclosure comprise one or more mutations that may affect thermal stability of the enzyme, and/or the ability of the enzyme to accept modified substrates, such as 3' or 5' modified substrates as disclosed herein. In some embodiments, said mutation or mutations may comprise one or more substitutions, deletions, or insertions at, or at a position or location surrounding, position 417 of SEQ ID NO: 1, 393 or 391, or any combination thereof, or homologs or orthologs thereof. In some embodiments, said mutation or mutations may comprise substitution of said residues with any of the 20 natural amino acids (i.e., W, I, M, P, F, G, A, V, L, H, E, R, K, D, N, Y, C, S, T, or Q) or with non-natural amino acids as are known to those of skill in the art. In some embodiments, said mutation or mutations may comprise the substitution Y417T, Y417S, Y417G, Y417A, Y417V, Y417I or Y417Y. In some embodiments, said mutation may be combined with one or more mutations at other positions, such as one or more substitutions, deletions, or insertions at, or at a position or location surrounding, any of positions 403, 405, 406, 414, 415, 416, 418, 468, 493, 495, 499, 501, 502, 507, 515, 529 and/or 567 or any combination thereof.

In some embodiments, the compositions and methods of the present disclosure comprise one or more mutations that may affect thermal stability of the enzyme, and/or the ability of the enzyme to accept modified substrates, such as 3' or 5' modified substrates as disclosed herein. In some embodiments, said mutation or mutations may comprise one or more substitutions, deletions, or insertions at, or at a position or location surrounding, position 418 of SEQ ID NO: 1, 393 or 391, or any combination thereof, or homologs or orthologs thereof. In some embodiments, said mutation or mutations may comprise substitution of said residues with any of the 20 natural amino acids (i.e., W, I, M, P, F, G, A, V, L, H, E, R, K, D, N, Y, C, S, T, or Q) or with non-natural amino acids as are known to those of skill in the art. In some embodiments, said mutation or mutations may comprise the substitution P418S, P418G, P418V, P418C, P418K, P418I, P418T or P418P. In some embodiments, said mutation may be combined with one or more mutations at other positions, such as one or more substitutions, deletions, or insertions at, or at a position or location surrounding, any of positions 403, 405, 406, 414, 415, 416, 417, 468, 493, 495, 499, 501, 502, 507, 515, 529 and/or 567 or any combination thereof.

In some embodiments, the compositions and methods of the present disclosure comprise one or more mutations that may affect thermal stability of the enzyme, and/or the ability of the enzyme to accept modified substrates, such as 3' or 5' modified substrates as disclosed herein. In some embodiments, said mutation or mutations may comprise one or more substitutions, deletions, or insertions at, or at a position or location surrounding, position 468 of SEQ ID NO: 1, 393 or 391, or any combination thereof, or homologs or orthologs thereof. In some embodiments, said mutation or mutations may comprise substitution of said residues with any of the 20 natural amino acids (i.e., W, I, M, P, F, G, A, V, L, H, E, R, K, D, N, Y, C, S, T, or Q) or with non-natural amino acids as are known to those of skill in the art. In some embodiments, said mutation or mutations may comprise the substitution R468A, R468V, R468S, R468K, R468H or R468G. In some embodiments, said mutation may be combined with one or more mutations at other positions, such as one or more substitutions, deletions, or insertions at, or at a position or location surrounding, any of positions 403, 405, 406, 414, 415, 416, 417, 418, 493, 495, 499, 501, 502, 507, 515, 529 and/or 567 or any combination thereof.

In some embodiments, the compositions and methods of the present disclosure comprise one or more mutations that may affect thermal stability of the enzyme, and/or the ability of the enzyme to accept modified substrates, such as 3' or 5' modified substrates as disclosed herein. In some embodiments, said mutation or mutations may comprise one or more substitutions, deletions, or insertions at, or at a position or location surrounding, position 493 of SEQ ID NO: 1, 393 or 391, or any combination thereof, or homologs or orthologs thereof. In some embodiments, said mutation or mutations may comprise substitution of said residues with any of the 20 natural amino acids (i.e., W, I, M, P, F, G, A, V, L, H, E, R, K, D, N, Y, C, S, T, or Q) or with non-natural amino acids as are known to those of skill in the art. In some embodiments, said mutation or mutations may comprise the substitution A493V or A493S. In some embodiments, said mutation may be combined with one or more mutations at other positions, such as one or more substitutions, deletions, or insertions at, or at a position or location surrounding, any of positions 403, 405, 406, 414, 415, 416, 417, 418, 468, 495, 499, 501, 502, 507, 515, 529 and/or 567 or any combination thereof.

In some embodiments, the compositions and methods of the present disclosure comprise one or more mutations that may affect thermal stability of the enzyme, and/or the ability of the enzyme to accept modified substrates, such as 3' or 5' modified substrates as disclosed herein. In some embodiments, said mutation or mutations may comprise one or more substitutions, deletions, or insertions at, or at a position or location surrounding, position 495 of SEQ ID NO: 1, 393 or 391, or any combination thereof, or homologs or orthologs thereof. In some embodiments, said mutation or mutations may comprise substitution of said residues with any of the 20 natural amino acids (i.e., W, I, M, P, F, G, A, V, L, H, E, R, K, D, N, Y, C, S, T, or Q) or with non-natural amino acids as are known to those of skill in the art. In some embodiments, said mutation or mutations may comprise the substitution K495G, K495A, K495Q, K495S, or K495V. In some embodiments, said mutation may be combined with one or more mutations at other positions, such as one or more substitutions, deletions, or insertions at, or at a position or location surrounding, any of positions 403, 405, 406, 414, 415, 416, 417, 418, 468, 493, 499, 501, 502, 507, 515, 529 and/or 567 or any combination thereof.

In some embodiments, the compositions and methods of the present disclosure comprise one or more mutations that may affect thermal stability of the enzyme, and/or the ability of the enzyme to accept modified substrates, such as 3' or 5' modified substrates as disclosed herein. In some embodiments, said mutation or mutations may comprise one or more substitutions, deletions, or insertions at, or at a position or location surrounding, position 499 of SEQ ID NO: 1, 393 or 391, or any combination thereof, or homologs or orthologs thereof. In some embodiments, said mutation or mutations may comprise substitution of said residues with any of the 20 natural amino acids (i.e., W, I, M, P, F, G, A, V, L, H, E, R, K, D, N, Y, C, S, T, or Q) or with non-natural amino acids as are known to those of skill in the art. In some embodiments, said mutation or mutations may comprise the substitution N499G, N499A, N499S, or N499V. In some embodiments, said mutation may be combined with one or more mutations at other positions, such as one or more substitutions, deletions, or insertions at, or at a position or location surrounding, any of positions 403, 405, 406, 414, 415, 416, 417, 418, 468, 493, 495, 501, 502, 507, 515, 529 and/or 567 or any combination thereof.

In some embodiments, the compositions and methods of the present disclosure comprise one or more mutations that may affect thermal stability of the enzyme, and/or the ability of the enzyme to accept modified substrates, such as 3' or 5' modified substrates as disclosed herein. In some embodiments, said mutation or mutations may comprise one or more substitutions, deletions, or insertions at, or at a position or location surrounding, position 501 of SEQ ID NO: 1, 393 or 391, or any combination thereof, or homologs or orthologs thereof. In some embodiments, said mutation or mutations may comprise substitution of said residues with any of the 20 natural amino acids (i.e., W, I, M, P, F, G, A, V, L, H, E, R, K, D, N, Y, C, S, T, or Q) or with non-natural amino acids as are known to those of skill in the art. In some embodiments, said mutation or mutations may comprise the substitution M501I. In some embodiments, said mutation may be combined with one or more mutations at other positions, such as one or more substitutions, deletions, or insertions at, or at a position or location surrounding, any of positions 403, 405, 406, 414, 415, 416, 417, 418, 468, 493, 495, 499, 502, 507, 515, 529 and/or 567 or any combination thereof.

In some embodiments, the compositions and methods of the present disclosure comprise one or more mutations that may affect thermal stability of the enzyme, and/or the ability of the enzyme to accept modified substrates, such as 3' or 5' modified substrates as disclosed herein. In some embodiments, said mutation or mutations may comprise one or more substitutions, deletions, or insertions at, or at a position or location surrounding, position 502 of SEQ ID NO: 1, 393 or 391, or any combination thereof, or homologs or orthologs thereof. In some embodiments, said mutation or mutations may comprise substitution of said residues with any of the 20 natural amino acids (i.e., W, I, M, P, F, G, A, V, L, H, E, R, K, D, N, Y, C, S, T, or Q) or with non-natural amino acids as are known to those of skill in the art. In some embodiments, said mutation or mutations may comprise the substitution Y502T, Y502V, Y502S, Y502R, Y502G, Y502N, Y502A, Y502Q, Y502P, Y502H, or Y502F. In some embodiments, said mutation may be combined with one or more mutations at other positions, such as one or more substitutions, deletions, or insertions at, or at a position or location surrounding, any of positions 403, 405, 406, 414, 415, 416, 417, 418, 468, 493, 495, 499, 501, 507, 515, 529 and/or 567 or any combination thereof.

In some embodiments, the compositions and methods of the present disclosure comprise one or more mutations that may affect thermal stability of the enzyme, and/or the ability of the enzyme to accept modified substrates, such as 3' or 5' modified substrates as disclosed herein. In some embodiments, said mutation or mutations may comprise one or more substitutions, deletions, or insertions at, or at a position or location surrounding, position 507 of SEQ ID NO: 1, 393 or 391, or any combination thereof, or homologs or orthologs thereof. In some embodiments, said mutation or mutations may comprise substitution of said residues with any of the 20 natural amino acids (i.e., W, I, M, P, F, G, A, V, L, H, E, R, K, D, N, Y, C, S, T, or Q) or with non-natural amino acids as are known to those of skill in the art. In some embodiments, said mutation or mutations may comprise the substitution F507S. In some embodiments, said mutation may be combined with one or more mutations at other positions, such as one or more substitutions, deletions, or insertions at, or at a position or location surrounding, any of positions 403, 405, 406, 414, 415, 416, 417, 418, 468, 493, 495, 499, 501, 502, 515, 529 and/or 567 or any combination thereof.

In some embodiments, the compositions and methods of the present disclosure comprise one or more mutations that may affect thermal stability of the enzyme, and/or the ability of the enzyme to accept modified substrates, such as 3' or 5' modified substrates as disclosed herein. In some embodiments, said mutation or mutations may comprise one or more substitutions, deletions, or insertions at, or at a position or location surrounding, position 515 of SEQ ID NO: 1, 393 or 391, or any combination thereof, or homologs or orthologs thereof. In some embodiments, said mutation or mutations may comprise substitution of said residues with any of the 20 natural amino acids (i.e., W, I, M, P, F, G, A, V, L, H, E, R, K, D, N, Y, C, S, T, or Q) or with non-natural amino acids as are known to those of skill in the art. In some embodiments, said mutation or mutations may comprise the substitution R515L, R515W, R515Y, R515P or R515F. In some embodiments, said mutation may be combined with one or more mutations at other positions, such as one or more substitutions, deletions, or insertions at, or at a position or location surrounding, any of positions 403, 405, 406, 414, 415, 416, 417, 418, 468, 493, 495, 499, 501, 502, 507, 529 and/or 567 or any combination thereof.

In some embodiments, the compositions and methods of the present disclosure comprise one or more mutations that may affect thermal stability of the enzyme, and/or the ability of the enzyme to accept modified substrates, such as 3' or 5' modified substrates as disclosed herein. In some embodiments, said mutation or mutations may comprise one or more substitutions, deletions, or insertions at, or at a position or location surrounding, position 529 of SEQ ID NO: 1, 393 or 391, or any combination thereof, or homologs or orthologs thereof. In some embodiments, said mutation or mutations may comprise substitution of said residues with any of the 20 natural amino acids (i.e., W, I, M, P, F, G, A, V, L, H, E, R, K, D, N, Y, C, S, T, or Q) or with non-natural amino acids as are known to those of skill in the art. In some embodiments, said mutation or mutations may comprise the substitution I529H, I529T, I529V, I529S, I529G, I529A, I529L, or I529F. In some embodiments, said mutation may be combined with one or more mutations at other positions, such as one or more substitutions, deletions, or insertions at, or at a position or location surrounding, any of positions 403, 405, 406, 414, 415, 416, 417, 418, 468, 493, 495, 499, 501, 502, 507, 515 and/or 567, or any combination thereof.

In some embodiments, the compositions and methods of the present disclosure comprise one or more mutations that may affect thermal stability of the enzyme, and/or the ability of the enzyme to accept modified substrates, such as 3' or 5' modified substrates as disclosed herein. In some embodiments, said mutation or mutations may comprise one or more substitutions, deletions, or insertions at, or at a position or location surrounding, position 567 of SEQ ID NO: 1, 393 or 391, or any combination thereof, or homologs or orthologs thereof. In some embodiments, said mutation or mutations may comprise substitution of said residues with any of the 20 natural amino acids (i.e., W, I, M, P, F, G, A, V, L, H, E, R, K, D, N, Y, C, S, T, or Q) or with non-natural amino acids as are known to those of skill in the art. In some embodiments, said mutation or mutations may comprise the substitution N567D. In some embodiments, said mutation may be combined with one or more mutations at other positions, such as one or more substitutions, deletions, or insertions at, or at a position or location surrounding, any of positions 403, 405, 406, 414, 415, 416, 417, 418, 468, 493, 495, 499, 501, 502, 507, 515, and/or 529 or any combination thereof.

In some embodiments, the methods and compositions provide for polymerase variants having increased thermostability, and especially increased tolerance for the incorporation of nonstandard nucleotides, such as 3'-blocked nucleotides. In some embodiments, the methods and compositions of the present disclosure comprise one or more polypeptides having 100%, at least 99.8%, at least 99.7%, at least 99.6%, at least 99.5%, at least 99.4%, at least 99.3%, at least 99.2%, at least 99.1%, at least 99%, at least 98%, at least 97%, at least 95%, at least 90% at least 85%, at least 80%, at least 75%, at least 70%, at least 65%, at least 60%, at least 55%, or at least 50% sequence identity to SEQ ID NO: 2-274 or 288-375 or 385-397, the methods and compositions of the present disclosure comprise one or more polypeptides having 100%, at least 99.8%, at least 99.7%, at least 99.6%, at least 99.5%, at least 99.4%, at least 99.3%, at least 99.2%, at least 99.1%, at least 99%, at least 98%, at least 97%, at least 95%, at least 90% at least 85%, at least 80%, at least 75%, at least 70%, at least 65%, at least 60%, at least 55%, or at least 50% sequence identity to any of SEQ ID NO: 2-274 or 288-375 or 385-397. In some embodiments, the methods and compositions of the present disclosure comprise one or more polypeptides having 100%, at least 99.8%, at least 99.7%, at least 99.6%, at least 99.5%, at least 99.4%, at least 99.3%, at least 99.2%, at least 99.1%, at least 99%, at least 98%, at least 97%, at least 95%, at least 90% at least 85%, at least 80%, at least 75%, at least 70%, at least 65%, at least 60%, at least 55%, or at least 50% sequence identity to any of SEQ ID NO: 2-274 or 288-375 or 385-397, having one or more mutations selected from R615K, Y654A, Y654D, Y654E, Y654F, Y654G, S655A, 5655G, S655V, Q656A, Q656G, Q656N, Q656S, Q656V, I657A, I657G, I657S, I657V, E658A, E658D, E658G, E658S, E658V, L659A, L659G, L659P, L659S, L659V, D680A, D680G, D680I, D680L, D680N, D680S, D680V, H682A, H682G, H682N, H682Q, H682S, H682V, R702A, R702G, R702H, R702K, R702S, R702V, K706H, K706K, K706R, A707G, A707S, A707T, F710A, F710D, F710E, F710G, F710Q, F710S, F710T, F710V, Y714A, Y714D, Y714E, Y714F, Y714G, Y714S, Y714W, H829A, and/or H829G or any combination thereof.

In some embodiments, the methods and compositions provide for polymerase variants having increased tolerance for the incorporation of nonstandard nucleotides, such as 3'-blocked nucleotides, and especially enhanced thermostability. In some embodiments, the methods and compositions of the present disclosure comprise one or more polypeptides having 100%, at least 99.8%, at least 99.7%, at least 99.6%, at least 99.5%, at least 99.4%, at least 99.3%, at least 99.2%, at least 99.1%, at least 99%, at least 98%, at least 97%, at least 95%, at least 90% at least 85%, at least 80%, at least 75%, at least 70%, at least 65%, at least 60%, at least 55%, or at least 50% sequence identity to SEQ ID NO: 2-274 or 288-375 or 385-397, the methods and compositions of the present disclosure comprise one or more polypeptides having 100%, at least 99.8%, at least 99.7%, at least 99.6%, at least 99.5%, at least 99.4%, at least 99.3%, at least 99.2%, at least 99.1%, at least 99%, at least 98%, at least 97%, at least 95%, at least 90% at least 85%, at least 80%, at least 75%, at least 70%, at least 65%, at least 60%, at least 55%, or at least 50% sequence identity to any of SEQ ID NO: 2-274 or 288-375 or 385-397 In some embodiments, the methods and compositions of the present disclosure comprise one or more polypeptides having 100%, at least 99.8%, at least 99.7%, at least 99.6%, at least 99.5%, at least 99.4%, at least 99.3%, at least 99.2%, at least 99.1%, at least 99%, at least 98%, at least 97%, at least 95%, at least 90% at least 85%, at least 80%, at least 75%, at least 70%, at least 65%, at least 60%, at least 55%, or at least 50% sequence identity to any of SEQ ID NO: 2-274 or 288-375 or 385-397, having one or more mutations selected from D314E, I332L, I334L, K368R, K381R, I385L, K417R, K434R, I454L, D471E, I528L, K601R, K635R, I649L, I665L, K758R and/or K760R or any combination thereof.

In some embodiments, the methods and compositions provide for polymerase variants having increased thermostability, and especially increased tolerance for the incorporation of nonstandard nucleotides, such as 3'-blocked nucleotides. In some embodiments, the methods and compositions of the present disclosure comprise one or more polypeptides having 100%, at least 99.8%, at least 99.7%, at least 99.6%, at least 99.5%, at least 99.4%, at least 99.3%, at least 99.2%, at least 99.1%, at least 99%, at least 98%, at least 97%, at least 95%, at least 90% at least 85%, at least 80%, at least 75%, at least 70%, at least 65%, at least 60%, at least 55%, or at least 50% sequence identity to SEQ ID NO: 2-274 or 288-375 or 385-397, the methods and compositions of the present disclosure comprise one or more polypeptides having 100%, at least 99.8%, at least 99.7%, at least 99.6%, at least 99.5%, at least 99.4%, at least 99.3%, at least 99.2%, at least 99.1%, at least 99%, at least 98%, at least 97%, at least 95%, at least 90% at least 85%, at least 80%, at least 75%, at least 70%, at least 65%, at least 60%, at least 55%, or at least 50% sequence identity to any of SEQ ID NO: 2-274 or 288-375 or 385-397. In some embodiments, the methods and compositions of the present disclosure comprise one or more polypeptides having 100%, at least 99.8%, at least 99.7%, at least 99.6%, at least 99.5%, at least 99.4%, at least 99.3%, at least 99.2%, at least 99.1%, at least 99%, at least 98%, at least 97%, at least 95%, at least 90% at least 85%, at least 80%, at least 75%, at least 70%, at least 65%, at least 60%, at least 55%, or at least 50% sequence identity to any of SEQ ID NO: 2-274 or 288-375 or 385-397, having one or more mutations selected from R615K, Y654A, Y654D, Y654E, Y654F, Y654G, S655A, 5655G, S655V, Q656A, Q656G, Q656N, Q656S, Q656V, I657A, I657G, I657S, I657V, E658A, E658D, E658G, E658S, E658V, L659A, L659G, L659P, L659S, L659V, D680A, D680G, D680I, D680L, D680N, D680S, D680V, H682A, H682G, H682N, H682Q, H682S, H682V, R702A, R702G, R702H, R702K, R702S, R702V, K706H, K706K, K706R, A707G, A707S, A707T, F710A, F710D, F710E, F710G, F710Q, F710S, F710T, F710V, Y714A, Y714D, Y714E, Y714F, Y714G, Y714S, Y714W, H829A, H829G D314E, I332L, I334L, K368R, K381R, I385L, K417R, K434R, I454L, D471E, I528L, K601R, K635R, I649L, I665L, K758R and/or K760R or any combination thereof.

The present disclosure provides polymerases from Candidatus Altiarchaeales archaeon that are truncated polypeptides that exhibit increased thermal stability, for example a polymerase having the amino acid sequence of SEQ ID NOS: 353 or 354.

The present disclosure provides polymerases from Candidatus Altiarchaeales archaeon that are mutated at two or more positions to increase the incorporation rate of nucleotide analogs. In some embodiments, mutant polymerases from Candidatus Altiarchaeales archaeon comprises the amino acid sequence of SEQ ID NO: 1 or 391 having one or more amino acid substitution mutations which are selected from a group consisting of L416, Y417, P418, A493 and/or I529, and also include one or more amino acid substitution mutations which are selected from a group consisting of K58, R515, N567, E569, S577, K610 and/or S717. In some embodiments, the amino acid substitution mutation at position K58 comprises a polar noncharged amino acid. In some embodiments, the amino acid substitution mutation at position K58 comprises methionine. In some embodiments, the amino acid substitution mutation at position R515 comprises a nonpolar amino acid or a polar uncharged amino acid. In some embodiments, the amino acid substitution mutation at position R515 comprises leucine, tryptophan, tyrosine, proline or phenylalanine. In some embodiments, the amino acid substitution mutation at position N567 comprises a negatively charged amino acid. In some embodiments, the amino acid substitution mutation at position N567 comprises aspartic acid. In some embodiments, the amino acid substitution mutation at position E569 comprises a nonpolar amino acid. In some embodiments, the amino acid substitution mutation at position E569 comprises glycine. In some embodiments, the amino acid substitution mutation at position S577 comprises a nonpolar amino acid. In some embodiments, the amino acid substitution mutation at position S577 comprises isoleucine. In some embodiments, the amino acid substitution mutation at position K610 comprises a negatively charged amino acid. In some embodiments the amino acid substitution mutation at position K610 comprises glutamic acid. In some embodiments, the amino acid substitution mutation at position S5717 comprises a nonpolar amino acid. In some embodiments, the amino acid substitution mutation at position S717 comprises glycine. In some embodiments, the amino acid substitution mutations can also include D141A and E143A.

The present disclosure provides polymerases from Candidatus Altiarchaeales archaeon that are mutated at two or more positions to increase the incorporation rate of nucleotide analogs compared to a wild type polymerase comprising SEQ ID NO: 1 or 391. In some embodiments, the mutant polymerases exhibit increased thermal stability compared to the wild type polymerase having the amino acid sequence of SEQ ID NO: 1 or 391. For example, the mutant polymerases exhibit increased thermal stability at a temperature range of about 25-50° C. or about 45-75° C. In some embodiments, the mutant polymerases comprise an amino acid sequence that is at least 80%, 85%, 90%, 95%, 99%, 99.1%, 99.2%, 99.3%, 99.4%, 99.5%, 99.6%, 99.7%, 99.8% identical, or a higher level sequence identity, to any of SEQ ID NOS: 1 or 2-274 or 288-375 or 385-397. A mutant polymerase may include any of the features described in this paragraph. For example. in some embodiments, the mutant polymerases from Candidatus Altiarchaeales archaeon comprise an amino acid sequence having at least 85% sequence identity, at least 90% sequence identity, or at least 95% sequence identity, or at least 96% sequence identity, or at least 97% sequence identity, or at least 98% sequence identity, or at least 99.8%, at least 99.7%, at least 99.6%, at least 99.5%, at least 99.4%, at least 99.3%, at least 99.2%, at least 99.1%, at least 99% sequence identity, or a higher percent sequence identity to SEQ ID NO: 1, 393 or 391, where the mutant DNA polymerase comprises an amino acid substitution at any one or any combination of two or more positions selected from a group consisting of Leu416, Tyr417, Pro418, Ala493, Arg515, Ile529 and Asn567. In some embodiments, the mutant polymerases include amino acid substitutions D141A and E143A which can confer exonuclease-minus activity. In some embodiments, the mutant polymerases exhibit desirable characteristics compared to a polymerase having a wild type amino acid backbone sequence (e.g., SEQ ID NO: 1 or 391). For example, the mutant polymerases exhibit increased thermal stability (Tm). In another example, the mutant polymerases exhibit increased incorporation rates of nucleotide analogs comprising a chain terminating moiety (e.g., blocking moiety) at the sugar 2' position and/or at the 3' sugar position. In yet another example, the mutant polymerases exhibit increased uracil-tolerance. One or more features described in this paragraph may appear in any example mutant polymerases in various embodiments described in this disclosure. The features described in this paragraph are referred to as "example mutant polymerase features" throughout this disclosure.

The present disclosure provides polymerases from Candidatus Altiarchaeales archaeon that are mutated in one or more positions to increase the incorporation rate of nucleotide analogs. In some embodiments, mutant polymerases from Candidatus Altiarchaeales archaeon comprises an amino acid sequence of having at least 80%, 85%, 90%, 95%, or higher percent sequence identity to any one of the amino acid sequences of SEQ ID NOS: 2-274 or 288-375 or 385-397.

The present disclosure provides archaeal family-B DNA polymerases, including 9° N DNA polymerases and THERMINATOR polymerases, that are mutated in one or more positions. In some embodiments, mutant 9° N and THERMINATOR polymerases comprise at least 80%, 85%, 90%, 95%, or higher percent sequence identity to SEQ ID NO: 280, 281 or 282, including one or more amino acid substitution mutations at positions Y7, T55, V106, D132, I264, Y291, P328, S348, L352, K363, E374, G395, W397, D398, R406, S407, L408, Y409, P410, Y431, D432, P435, C442, R460, R465, Y481, R484, A485, I486, K487, I488, N491, F493, Y494, Y499, C506, K507, C509, I521, K559, K561, P569, E600, K602, I603, D614, V643, E645, V661, Q665, R689, R709, I715, I744 and/or D754. In some embodiments, the one or more amino acid substitutions of SEQ ID NO: 280 are positionally equivalent to the amino acid substitutions at positions Y7, K58, C104, C130, C269, R296, P335, G355, R359, E370, D381, G403, H405, D406, R414, S415, L416, Y417, P418, D439, S440, S443, C450, R468, K473, V489, Q492, A493, L494, K495, L496, N499, S500, M501, Y502, F507, C514, R515, C517, I529, N567, E569, S577, R608, K610, L611, D622, V651, D653, A669, Q673, R697, S717, R723, I750 and E760, respectively, of a Candidatus Altiarchaeales archaeon polymerase which comprises the amino acid sequence of any one of SEQ ID NO: 1-274 or 288-375 or 385-397. In some embodiments, positionally equivalent amino acid positions of a Candidatus Altiarchaeales archaeon polymerase and 9° N polymerase, VENT polymerase, DEEP VENT polymerase, *Geobacillus stearothermophilus* polymerase, Pfu polymerase, and *Pyrococcus abyssi* polymerase, are listed in Table 4 shown in FIG. 6-1 through FIG. 6-3. See also the sequence alignments at FIG. 7-1 through FIG. 7-2, FIG. 8-1 through FIG. 8-3, FIG. 9-1 through FIG. 9-2, FIG. 10-1 through FIG. 10-2, FIG. 11-1 through FIG. 11-2, FIG. 12-1 through FIG. 12-2, and FIG. 13-1 through FIG. 13-2.

The present disclosure provides archaeal family-B DNA polymerases, including 9° N DNA polymerases, that are mutated in one or more positions. In some embodiments, mutant 9° N DNA polymerases comprise at least 80%, 85%, 90%, 95%, or higher percent sequence identity to SEQ ID NO: 280 including one or more amino acid substitution mutations at positions Y7, T55, V106, D132, I264, Y291, P328, S348, L352, K363, E374, G395, W397, D398, R406, S407, L408, Y409, P410, Y431, D432, P435, C442, R460, R465, Y481, R484, A485, I486, K487, I488, N491, F493, Y494, Y499, C506, K507, C509, I521, K559, K561, P569, E600, K602, I603, D614, V643, E645, V661, Q665, D672, R689, R709, I715, I744 and/or D754. In some embodiments, the amino acid at position 129 can be methionine or alanine. In some embodiments, the one or more amino acid substitutions of SEQ ID NO: 280 are positionally equivalent to the amino acid substitutions at positions K58, C104, C130, C269, R296, P335, G355, R359, E370, D381, G403, H405, D406, R414, S415, L416, Y417, P418, D439, S440, S443, C450, R468, K473, V489, Q492, A493, L494, K495, L496, N499, S500, M501, Y502, F507, C514, R515, C517, I529, N567, E569, S577, R608, K610, L611, D622, V651, D653, A669, Q673, R697, S717, R723, I750 and E760, respectively, of a Candidatus Altiarchaeales archaeon polymerase which comprises the amino acid sequence of any one of SEQ ID NO: 1-274 or 288-375 or 385-397. In some embodiments, positionally equivalent amino acid positions of a Candidatus Altiarchaeales archaeon polymerase and 9° N polymerase are listed in Table 4 shown in FIG. 6-1 through FIG. 6-3. See also the sequence alignment at FIG. 7-1 through FIG. 7-3.

The present disclosure provides archaeal family-B DNA polymerases, including 9° N DNA polymerases, that are mutated in one or more positions. In some embodiments, mutant 9° N DNA polymerases comprise at least 80%, 85%, 90%, 95%, or higher percent sequence identity to SEQ ID NO: 281 including one or more amino acid substitution mutations at positions Y7, T55, V106, D132, I264, Y291, P328, S348, L352, K363, E374, G395, W397, D398, R406, S407, L408, Y409, P410, Y431, D432, P435, C442, R460, R465, Y481, R484, A485, I486, K487, I488, N491, F493, Y494, Y499, C506, K507, C509, I521, K559, K561, P569, E600, K602, I603, D614, V643, E645, V661, Q665, D672, R689, R709, I715, I744 and/or D754. In some embodiments, the amino acid at position 129 can be methionine or alanine. In some embodiments, the one or more amino acid substitutions of SEQ ID NO: 281 are positionally equivalent to the amino acid substitutions at positions K58, C104, C130, C269, R296, P335, G355, R359, E370, D381, G403, H405, D406, R414, S415, L416, Y417, P418, D439, S440, S443, C450, R468, K473, V489, Q492, A493, L494, K495, L496, N499, S500, M501, Y502, F507, C514, R515, C517, I529, N567, E569, S577, R608, K610, L611, D622, V651, D653, A669, Q673, R697, S717, R723, I750 and E760, respectively, of a Candidatus Altiarchaeales archaeon polymerase which comprises the amino acid sequence of any one of SEQ ID NO: 1-274 or 288-375 or 385-397. In some embodiments, positionally equivalent amino acid positions of a Candidatus Altiarchaeales archaeon polymerase and 9° N polymerase are listed in Table 4 shown in FIG. 6-1 through FIG. 6-3. See also the sequence alignment at FIG. 7-1 through FIG. 7-2.

The present disclosure provides archaeal family-B DNA polymerases, including THERMINATOR DNA polymerases, that are mutated in one or more positions. In some embodiments, mutant THERMINATOR polymerases comprise at least 80%, 85%, 90%, 95%, or higher percent sequence identity to SEQ ID NO: 282 including one or more amino acid substitution mutations at positions Y7, T55, V106, D132, I264, Y291, P328, S348, L352, K363, E374, G395, W397, D398, R406, S407, L408, Y409, P410, Y431, D432, P435, C442, R460, R465, Y481, R484, A485, I486, K487, I488, N491, F493, Y494, Y499, C506, K507, C509, I521, K559, K561, P569, E600, K602, I603, D614, V643, E645, V661, Q665, D672, R689, R709, I715, I744 and/or D754. In some embodiments, the amino acid at position 129 can be methionine or alanine. In some embodiments, the one or more amino acid substitutions of SEQ ID NO: 282 are positionally equivalent to the amino acid substitutions at positions K58, C104, C130, C269, R296, P335, G355, R359, E370, D381, G403, H405, D406, R414, S415, L416, Y417, P418, D439, S440, S443, C450, R468, K473, V489, Q492, A493, L494, K495, L496, N499, S500, M501, Y502, F507, C514, R515, C517, S529, N567, E569, S577, R608, K610, L611, D622, V651, D653, A669, Q673, R697, S717, R723, I750 and E760, respectively, of a Candidatus Altiarchaeales archaeon polymerase which comprises the amino acid sequence of any one of SEQ ID NO: 1-274 or 288-375 or 385-397. In some embodiments, positionally equivalent amino acid positions of a Candidatus Altiarchaeales archaeon polymerase and THERMINATOR polymerase correspond to the positions of 9° N polymerase that are listed in Table 4 shown in FIG. 6-1 through FIG. 6-3. See also the sequence alignment at FIG. 7-1 through FIG. 7-2.

The present disclosure provides archaeal family-B DNA polymerases, including VENT DNA polymerases, that are mutated in one or more positions. In some embodiments, mutant VENT DNA polymerases comprise at least 80%, 85%, 90%, 95%, or higher percent sequence identity to SEQ ID NO: 283 including one or more amino acid substitution mutations at positions Y7, K61, V106, D132, V266, G293, P330, S350, L354, A365, E376, G398, W400, E401, R409, S410, L411, Y412, P413, Y434, D435, P438, C445, R463, K468, Y484, R487, A488, I489, K490, L491, N494, I496, Y1035, Y1040, S1047, K1048, C1050, I1062, K1490, K1492, S1500, E1531, R1533, I1534, D1545, V1574, D1576, V1592, Q1596, D1604, R1620, K1640, I1646, I1675 and/or D1685. In some embodiments, the one or more amino acid substitutions of SEQ ID NO: 283 are positionally equivalent to the amino acid substitutions at positions K58, C104, C130, C269, R296, P335, G355, R359, E370, D381, G403, H405, D406, R414, S415, L416, Y417, P418, D439, S440, S443, C450, R468, K473, V489, Q492, A493, L494, K495, L496, N499, S500, M501, Y502, F507, C514, R515, C517, I529, N567, E569, S577, R608, K610, L611, D622, V651, D653, A669, Q673, R697, 5717, R723, I750 and E760, respectively, of a Candidatus Altiarchaeales archaeon polymerase which comprises the amino acid sequence of any one of SEQ ID NO: 1-274 or 288-375 or 385-397. In some embodiments, positionally equivalent amino acid positions of a Candidatus Altiarchaeales archaeon polymerase and VENT polymerase are listed in Table 4 shown in FIG. 6-1 through FIG. 6-3. See also the sequence alignment at FIG. 8-1 through FIG. 8-3.

The present disclosure provides archaeal family-B DNA polymerases, including DEEP VENT DNA polymerases, that are mutated in one or more positions. In some embodiments, mutant DEEP VENT DNA polymerases comprise at least 80%, 85%, 90%, 95%, or higher percent sequence identity to SEQ ID NO: 284 including one or more amino acid substitution mutations at positions Y7, K61, V106, D132, I264, Y291, P328, S348, L352, E363, E374, G396, W398, E399, R407, S408, L409, Y410, P411, Y432, D433, P436, C443, R461, R466, Y482, R485, A486, I487, K488, I489, N492, I494, Y1032, Y1037, C1044, K1045, C1047, I1059, K1097, L1099, A1107, E1138, K1140, I1141, D1152, V1181, E1183, V1199, Q1203, E1210, R1227, P1247, I1253, I1282 and/or D1292. In some embodiments, the one or more amino acid substitutions of SEQ ID NO: 284 are positionally equivalent to the amino acid substitutions at positions K58, C104, C130, C269, R296, P335, G355, R359, E370, D381, G403, H405, D406, R414, S415, L416, Y417, P418, D439, S440, S443, C450, R468, K473, V489, Q492, A493, L494, K495, L496, N499, S500, M501, Y502, F507, C514, R515, C517, I529, N567, E569, S577, R608, K610, L611, D622, V651, D653, A669, Q673, R697, S717, R723, I750 and E760, respectively, of a Candidatus Altiarchaeales archaeon polymerase which comprises the amino acid sequence of any one of SEQ ID NO: 1-274 or 288-375 or 385-397. In some embodiments, positionally equivalent amino acid positions of a Candidatus Altiarchaeales archaeon polymerase and DEEP VENT polymerase are listed in Table 4 shown in FIG. 6-1 through FIG. 6-3. See also the sequence alignment at FIG. 9-1 through FIG. 9-2.

The present disclosure provides archaeal family-B DNA polymerases, including Pfu DNA polymerases, that are mutated in one or more positions. In some embodiments, mutant Pfu DNA polymerases comprise at least 80%, 85%, 90%, 95%, or higher percent sequence identity to SEQ ID NO: 285 including one or more amino acid substitution mutations at positions Y7, K61, V106, E150, I264, Y291, P328, S348, L352, E363, E374, G396, W398, E399, R407, S408, L409, Y410, P411, Y432, D433, P436, C443, R461, T466, Y482, K485, A486, I487, K488, L489, N492, F494, Y495, Y500, C507, K508, C510, I522, K560, L562, S570, E601, K603, V604, D615, V644, E646, A662, Q666, E673, K690, P710, I716, I745 and/or D755. In some embodiments, the one or more amino acid substitutions of SEQ ID NO: 285 are positionally equivalent to the amino acid substitutions at positions K58, C104, C130, C269, R296, P335, G355, R359, E370, D381, G403, H405, D406, R414, S415, L416, Y417, P418, D439, S440, S443, C450, R468, K473, V489, Q492, A493, L494, K495, L496, N499, S500, M501, Y502, F507, C514, R515, C517, I529, N567, E569, S577, R608, K610, L611, D622, V651, D653, A669, Q673, R697, S717, R723, I750 and E760, respectively, of a Candidatus Altiarchaeales archaeon polymerase which comprises the amino acid sequence of any one of SEQ ID NO: 1-274 or 288-375 or 385-397. In some embodiments, positionally equivalent amino acid positions of a Candidatus Altiarchaeales archaeon polymerase and Pfu polymerase are listed in Table 4 shown in FIG. 6-1 through FIG. 6-3. See also the sequence alignment at FIG. 11-1 through FIG. 11-2.

The present disclosure provides archaeal family-B DNA polymerases, including *Pyrococcus abyssi* DNA polymerases, that are mutated in one or more positions. In some embodiments, mutant *Pyrococcus abyssi* DNA polymerases comprise at least 80%, 85%, 90%, 95%, or higher percent sequence identity to SEQ ID NO: 286 including one or more amino acid substitution mutations at positions Y7, K61, V106, N132, I264, Y291, P328, S348, L352, E363, E374, G396, W398, E399, R407, S408, L409, Y410, P411, Y432, D433, P436, C443, R461, K466, Y482, R485, A486, I487, K488, I489, N492, Y494, Y495, Y500, C507, K508, C510, I522, K559, L561, S569, E600, K602, I603, D614, V643, E645, V661, Q665, E672, K689, P709, I715, I744 and/or D754. In some embodiments, the one or more amino acid substitutions of SEQ ID NO: 286 are positionally equivalent to the amino acid substitutions at positions K58, C104, C130, C269, R296, P335, G355, R359, E370, D381, G403, H405, D406, R414, S415, L416, Y417, P418, D439, S440, S443, C450, R468, K473, V489, Q492, A493, L494, K495, L496, N499, S500, M501, Y502, F507, C514, R515, C517, I529, N567, E569, S577, R608, K610, L611, D622, V651, D653, A669, Q673, R697, S717, R723, I750 and E760, respectively, of a Candidatus Altiarchaeales archaeon polymerase which comprises the amino acid sequence of any one of SEQ ID NO: 2-274 or 288-375 or 385-397. In some embodiments, positionally equivalent amino acid positions of a Candidatus Altiarchaeales archaeon polymerase and *Pyrococcus abyssi* polymerase are listed in Table 4 shown in FIG. 6-1 through FIG. 6-3. See also the sequence alignment at FIG. 12-1 through FIG. 12-2.

The present disclosure provides archaeal family-A DNA polymerases, including *Geobacillus stearothermophilus* DNA polymerases, that are mutated in one or more positions. In some embodiments, mutant *Geobacillus stearothermophilus* DNA polymerases comprise at least 80%, 85%, 90%, 95%, or higher percent sequence identity to SEQ ID NO: 275 including one or more amino acid substitution mutations at positions G10, D59, A97, Q123, S240, G277, E325, G342, R343, E349, A359, G384, E386, L387, L394, L395, L396, A397, A398, E420, A421, S424, K431, K450, W455, K476, Q479, P480, L481, A482, A483, A486, M488, E489, V493, G504, S505, L507, N527, N573, L575, S585, E632, R634, K635, D647, I689, H691, A707, G711, D718, P744, Y772, S799, V828 and/or E840. In some embodiments, the one or more amino acid substitutions of SEQ ID NO: 275 are positionally equivalent to the amino acid substitutions at positions K58, C104, C130, C269, R296, P335, G355, R359, E370, D381, G403, H405, D406, R414, S415, L416, Y417, P418, D439, S440, S443, C450, R468, K473, V489, Q492, A493, L494, K495, L496, N499, S500, M501, Y502, F507, C514, R515, C517, I529, N567, E569, S577, R608, K610, L611, D622, V651, D653, A669, Q673, R697, S717, R723, 1750 and E760, respectively, of a Candidatus Altiarchaeales archaeon polymerase which comprises the amino acid sequence of any one of SEQ ID NO: 1-274 or 288-375 or 385-397. In some embodiments, positionally equivalent amino acid positions of a Candidatus Altiarchaeales archaeon polymerase and *Geobacillus stearothermophilus* polymerase are listed in Table 4 shown in FIG. 6-1 through FIG. 6-3. See also the sequence alignment at FIG. 10-1 through FIG. 10-2.

The present disclosure provides polymerases operably linked to a detectable reporter moiety. Any of the polymerases described herein can be labeled with a detectable reporter moiety, including polymerases having a wild type or mutant amino acid sequence backbone of any polymerase described herein, including Candidatus Altiarchaeales archaeon DNA polymerases (e.g., any of SEQ ID NOS: 1-274 or 288-375 or 385-397), *Geobacillus* DNA polymerases (e.g., SEQ ID NOS: 275-279), 9° N DNA polymerases (e.g., SEQ ID NOS: 280 and 281), THERMINATOR DNA polymerase (e.g., SEQ ID NO: 282), VENT DNA polymerase (e.g., SEQ ID NO: 283), DEEP VENT DNA polymerase (e.g., SEQ ID NO: 284), Pfu DNA polymerase (e.g., SEQ ID NO: 285), *Pyrococcus abyssi* DNA polymerase (e.g., SEQ ID NO: 286), and RB69 DNA polymerase (e.g., SEQ ID NO: 287). In some embodiments, the detectable reporter moiety generates a detectable signal resulting from a chemical or physical change (e.g., heat, light, electrical, pH, salt concentration, enzymatic activity, or proximity events such as FRET). In some embodiments, the detectable reporter moiety comprises a luminescent moiety, fluorescent moiety, or quencher. In some embodiment, the detectable moiety comprises a fluorescent moiety that behaves as a FRET donor or acceptor. The detectable reporter moiety can be attached to the polymerase at the N-terminus, C-terminus or any internal location. The detectable reporter moiety is attached to the polymerase in a manner that does not interfere with the ability of the polymerase to bind a nucleic acid template molecule, a nucleic acid primer, or a nucleotide. The detectable reporter moiety is attached to the polymerase in a manner that does not interfere with catalytic activity of the polymerase including nucleotide incorporation.

The present disclosure provides recombinant fusion polypeptides which include any of the DNA polymerases described herein operably linked to any one or any combination of two or more exogenous amino acid sequences for affinity purification, cleavage or solubilization. In some embodiments, the recombinant fusion polypeptides comprise any of the wild type and mutant polymerases described herein, and polymerases having substitution mutations at sites that are positionally equivalent mutation sites to the sites shown in Table 4 (FIG. 6-1 through FIG. 6-3) described herein, including polymerases having an amino acid backbone sequence of a Candidatus Altiarchaeales archaeon DNA polymerases (e.g., any of SEQ ID NOS: 1-274 or 288-375 or 385-397), *Geobacillus* DNA polymerases (e.g., SEQ ID NOS: 275-279), 9° N DNA polymerases (e.g., SEQ ID NOS: 280 and 281), THERMINATOR DNA polymerase (e.g., SEQ ID NO: 282), VENT DNA polymerase (e.g., SEQ ID NO: 283), DEEP VENT DNA polymerase (e.g., SEQ ID NO: 284), Pfu DNA polymerase (e.g., SEQ ID NO: 285), *Pyrococcus abyssi* DNA polymerase (e.g., SEQ ID NO: 286), and RB69 DNA polymerase (e.g., SEQ ID NO: 287).

In some embodiments, the recombinant fusion polypeptides comprise any of the wild type and mutant polymerases described herein operably linked at their N- and/or C-terminus end(s) to at least one affinity purification tag sequence, where the affinity purification tag sequence(s) include a Histidine tag (e.g., hexa-histidine tag (SEQ ID NO: 398)), FLAG tag, T7 tag, Strep II tag, S tag (e.g., from pancreatic ribonuclease A), HA tag (e.g., from human influenza hemagglutinin protein) and/or c-Myc tag.

In some embodiments, the recombinant fusion polypeptides comprise any of the wild type and mutant polymerases described herein operably linked at their N- and/or C-terminus end(s) to at least one polypeptide cleavage sequence, or the polypeptide cleavage sequence can be positioned between an affinity tag sequence and the N-terminus or C-terminus end of the polymerase sequence. In some embodiments, the polypeptide cleavage sequence can be recognized and cleaved with a protease or a reducing condition. In some embodiments, the polypeptide cleavage sequence comprises a thrombin cleavage sequence, TEV cleavage sequence (e.g., from tobacco etch virus including AcTEV and ProTEV), factor Xa cleavage sequence, enterokinase cleavage sequence, and SUMO cleavage sequence (e.g., Small ubiquitin-like modified including Ulp1, Senp2 and SUMOstar).

In some embodiments, the recombinant fusion polypeptides comprise any of the wild type and mutant polymerases described herein operably linked at their N- and/or C-terminus end(s) to at least one exogenous amino acid sequence for improving solubilization, including maltose binding protein (MBP), small ubiquitin-like modifier (SUMO) and glutathione S-transferase (GST).

Systems Comprising Polymerases

The present disclosure provides a system comprising: one or more mutant polymerases and at least one nucleic acid template molecule having a self-priming 3' end. In some embodiments, the one or more mutant polymerases may, or may not, be bound to the at least one nucleic acid template molecule having a self-priming 3' end. In some embodiments, the self-priming 3' end of the template molecule provides an initiation site for nucleotide polymerization. In some embodiments, the mutant polymerases include one or more example mutant polymerase features discussed above.

The present disclosure provides a system comprising: one or more mutant polymerases and at least one nucleic acid template molecule and at least one nucleic acid primer. In some embodiments, the one or more mutant polymerases may, or may not, be bound to the at least one nucleic acid template molecule and at least one nucleic acid primer. In some embodiments, the primer provides an initiation site for nucleotide polymerization. In some embodiments, the primer comprises a 3' extendible end for a polymerase-catalyzed nucleotide incorporation reaction, or the primer comprises a 3' non-extendible end. In some embodiments, the nucleic acid template molecule includes at least one uridine nucleotide or lacks a uridine nucleotide. In some embodiments, the mutant polymerases include one or more example mutant polymerase features discussed above.

In some embodiments, the system comprises: one or more mutant polymerases bound to nucleic acid duplexes each comprising a nucleic acid template hybridized to a nucleic acid primer, thereby forming a complexed polymerase. In some embodiments, the primer provides an initiation site for nucleotide polymerization. In some embodiments, the mutant polymerase is bound to a nucleic acid template molecule having a self-priming 3' end to form a complexed polymerase that lacks a separate primer molecule. In some embodiments, the nucleic acid template molecule includes at least one uridine nucleotide or lacks a uridine nucleotide. In some embodiments, the mutant polymerases include one or more example mutant polymerase features discussed above.

In some embodiments, the system comprises one or more mutant polymerases, at least one nucleic acid template molecule, and an initiation site for nucleotide polymerization, wherein the mutant polymerases are in solution, the nucleic acid template molecules are in solution, and the initiation sites (e.g., primers) are in solution. In some embodiments, the system comprises one or more mutant polymerases, at least one nucleic acid template molecule, and an initiation site for nucleotide polymerization, wherein the system comprises any combination of mutant polymerases that are in solution, the nucleic acid template molecules that are in solution or immobilized to a support, and the initiation sites (e.g., primers) that are in solution or immobilized to a support. In some embodiments, the system comprises one or more mutant polymerases, at least one nucleic acid template molecule, and an initiation site for nucleotide polymerization, wherein the system comprises any combination of mutant polymerases that are in solution or immobilized to a support, the nucleic acid template molecules that are in solution or immobilized to a support, and the initiation sites (e.g., primers) that are in solution or immobilized to a support.

In some embodiments in the system, the mutant polymerases exhibit increased thermal stability compared to the wild type polymerase having the amino acid sequence of SEQ ID NO: 1 or 391. For example, the mutant polymerases exhibit increased thermal stability at a temperature range of about 25-50° C. or about 45-75° C.

In some embodiments in the system, the mutant polymerases exhibit increased incorporation rate of nucleotide analogs compared to a wild type polymerase comprising SEQ ID NO: 1 or 391, where the nucleotide analogs comprise a chain terminating moiety (e.g., blocking moiety) at the sugar 2' position and/or at the 3' sugar position.

In some embodiments, the system comprises: one or more mutant polymerases, and a plurality of nucleic acid duplexes each comprising a nucleic acid template hybridized to a nucleic acid primer. In some embodiments, the one or more polymerases and the nucleic acid duplex further comprises a plurality of nucleotides. The one or more mutant polymerases may or may not be bound to the nucleic acid duplex. The one or more mutant polymerases may or may not be bound to one of the nucleotides. In some embodiments, the one or mutant polymerases is bound to the nucleic acid duplex comprising a nucleic acid template hybridized to a nucleic acid primer, thereby forming a complexed polymerase, and the system further comprises a plurality of nucleotides. In some embodiments, the mutant polymerases include one or more example mutant polymerase features discussed above.

In some embodiments in the system, a nucleotide can bind to a complexed polymerase without incorporation. In some embodiments, a complementary nucleotide can bind a complexed polymerase without undergoing polymerase-catalyzed incorporation to form a ternary complex in which the complementary nucleotide binds the 3' end of the primer at a position that is opposite a complementary nucleotide in the template strand.

In some embodiments in the system, at least one nucleotide in the plurality of nucleotides comprise a base, sugar and at least one phosphate group. For example, a nucleotide unit may include an aromatic base, a five-carbon sugar (e.g., ribose or deoxyribose), and one or more phosphate groups (e.g., 1-10 phosphate groups), wherein the aromatic base of the nucleotide comprises adenine, guanine, cytosine, thymine or uracil. In some embodiments, the plurality of nucleotides comprises one type of nucleotide selected from a group consisting of dATP, dGTP, dCTP, dTTP and dUTP. In some embodiments, the plurality of nucleotides comprises a mixture of any combination of two or more types of nucleotides selected from a group consisting of dATP, dGTP, dCTP, dTTP and/or dUTP. In some embodiments, at least one of the nucleotides in the plurality of nucleotides is labeled with a fluorophore. In some embodiments, the plurality of nucleotides lack a fluorophore label. One or more features described in this paragraph may appear in any example nucleotide units in various embodiments described in this disclosure. The features described in this paragraph are referred to as "example nucleotide unit features" throughout this disclosure.

In some embodiments, in the system, at least one nucleotide in the plurality of nucleotides comprise a chain of one, two or three phosphorus atoms where the chain is typically attached to the 5' carbon of the sugar moiety via an ester or phosphoramide linkage. In some embodiments, at least one nucleotide in the plurality is an analog having a phosphorus chain in which the phosphorus atoms are linked together with intervening O, S, NH, methylene or ethylene. In some embodiments, the phosphorus atoms in the chain include substituted side groups including O, S or $BH_3$. In some embodiments, the chain includes phosphate groups substituted with analogs including phosphoramidate, phosphorothioate, phosphorodithioate, and O-methylphosphoroamidite groups.

In some embodiments, in the system, at least one nucleotide in the plurality of nucleotides comprises a nucleotide analog having a chain terminating moiety (e.g., blocking moiety) at the sugar 2' position, at the sugar 3' position, or at the sugar 2' and 3' position. In some embodiments, the chain terminating moiety can inhibit polymerase-catalyzed incorporation of a subsequent nucleotide unit or free nucleotide in a nascent strand during a primer extension reaction. In some embodiments, the chain terminating moiety is attached to the 3' sugar hydroxyl position where the sugar comprises a ribose or deoxyribose sugar moiety. In some embodiments, the chain terminating moiety is removable/cleavable from the 3' sugar hydroxyl position to generate a nucleotide having a 3'OH sugar group which is extendible with a subsequent nucleotide in a polymerase-catalyzed nucleotide incorporation reaction. In some embodiments, the chain terminating moiety comprises an alkyl group, alkenyl group, alkynyl group, allyl group, aryl group, benzyl group, azide group, amine group, amide group, keto group, isocyanate group, phosphate group, thio group, disulfide group, carbonate group, urea group, or silyl group. In some embodiments, the chain terminating moiety is cleavable/removable from the nucleotide, for example by reacting the chain terminating moiety with a chemical agent, pH change, light or heat. In some embodiments, the chain terminating moieties alkyl, alkenyl, alkynyl and allyl are cleavable with tetrakis(triphenylphosphine)palladium(0) ($Pd(PPh_3)_4$) with piperidine, or with 2,3-Dichloro-5,6-dicyano-1,4-benzo-quinone (DDQ). In some embodiments, the chain terminating moieties aryl and benzyl are cleavable with H2 Pd/C. In some embodiments, the chain terminating moieties amine, amide, keto, isocyanate, phosphate, thio, disulfide are cleavable with phosphine or with a thiol group including beta-mercaptoethanol or dithiothritol (DTT). In some embodiments, the chain terminating moiety carbonate is cleavable with potassium carbonate ($K_2CO_3$) in MeOH, with triethylamine in pyridine, or with Zn in acetic acid (AcOH). In some embodiments, the chain terminating moieties urea and silyl are cleavable with tetrabutylammonium fluoride, pyridine-HF, with ammonium fluoride, or with triethylamine trihydrofluoride. One or more features described in this paragraph of a nucleotide analog that include a chain terminating moiety may appear in any example nucleotide analogs in various embodiments described in this disclosure. The features of a nucleotide analog described in this paragraph are referred to as "example nucleotide analog features" throughout this disclosure. Likewise, one or more chain terminating moiety features described in this paragraph may appear in any example chain terminating moieties in various embodiments described in this disclosure. The phrase "chain terminating moiety embodiments" is used throughout this disclosure to refer to any of one or more chain terminating moiety features described in this paragraph.

In some embodiments, in the system, at least one nucleotide in the plurality of nucleotides comprises a terminator nucleotide analog having a chain terminating moiety (e.g., blocking moiety) at the sugar 2' position, at the sugar 3' position, or at the sugar 2' and 3' position. In some embodiments, the chain terminating moiety comprises an azide, azido or azidomethyl group. In some embodiments, the chain terminating moiety comprises a 3'-O-azido or 3'-O-azidomethyl group. In some embodiments, the chain terminating moieties azide, azido and azidomethyl group are cleavable/removable with a phosphine compound. In some embodiments, the phosphine compound comprises a derivatized tri-alkyl phosphine moiety or a derivatized tri-aryl phosphine moiety. In some embodiments, the phosphine compound comprises Tris(2-carboxyethyl)phosphine (TCEP) or bis-sulfo triphenyl phosphine (BS-TPP) or Tri (hydroxyproyl)phosphine (THPP). In some embodiments, the cleaving agent comprises 4-dimethylaminopyridine (4-DMAP). In some embodiments, in the system, the nucleotide analog comprise a chain terminating moiety which is selected from a group consisting of 3'-deoxy nucleotides, 2',3'-dideoxynucleotides, 3'-methyl, 3'-azido, 3'-azidomethyl, 3'-O-azidoalkyl, 3'-O -ethynyl, 3'-O-aminoalkyl, 3'-O-fluoroalkyl, 3'-fluoromethyl, 3'-difluoromethyl, 3'-trifluoromethyl, 3'-sulfonyl, 3'-malonyl, 3'-amino, 3'-O-amino, 3'-sulfhydral, 3'-aminomethyl, 3'-ethyl, 3'butyl, 3'-tert butyl, 3'-Fluorenylmethyloxycarbonyl, 3' tert-Butyloxy carbonyl, 3'-O-alkyl hydroxylamino group, 3'-phosphorothioate, and 3-O-benzyl, or derivatives thereof. One or more features described in this paragraph may appear in any chain terminating moiety that includes an azide, azido or azidomethyl group in various embodiments described in this disclosure. The phrase "chain terminating moiety comprises an azide, azido or azidomethyl group" is used throughout this disclosure to refer to any of one or more chain terminating moiety features described in this paragraph.

In some embodiments, in the system, the plurality of nucleotides comprises a plurality of nucleotides that lack a detectable reporter moiety, for example a fluorophore. In some embodiments, in the system, the plurality of nucleotides comprises a plurality of nucleotides labeled with detectable reporter moiety. The detectable reporter moiety comprises a fluorophore. In some embodiments, the fluorophore is attached to the nucleotide base. In some embodiments, the fluorophore is attached to the nucleotide base with a linker which is cleavable/removable from the base.

In some embodiments, in the system, the cleavable linker on the base comprises a cleavable moiety comprising an alkyl group, alkenyl group, alkynyl group, allyl group, aryl group, benzyl group, azide group, amine group, amide group, keto group, isocyanate group, phosphate group, thio group, disulfide group, carbonate group, urea group, or silyl group. In some embodiments, the cleavable linker on the base is cleavable/removable from the base by reacting the cleavable moiety with a chemical agent, pH change, light or heat. In some embodiments, the cleavable moieties alkyl, alkenyl, alkynyl and allyl are cleavable with tetrakis(triphenylphosphine)palladium(0) ($Pd(PPh_3)_4$) with piperidine, or with 2,3-Dichloro-5,6-dicyano-1,4-benzo-quinone (DDQ). In some embodiments, the cleavable moieties aryl and benzyl are cleavable with H2 Pd/C. In some embodiments, the cleavable moieties amine, amide, keto, isocyanate, phosphate, thio, disulfide are cleavable with phosphine or with a thiol group including beta-mercaptoethanol or dithiothritol (DTT). In some embodiments, the cleavable moiety carbonate is cleavable with potassium carbonate ($K_2CO_3$) in MeOH, with triethylamine in pyridine, or with Zn in acetic acid (AcOH). In some embodiments, the cleavable moieties urea and silyl are cleavable with tetrabutylammonium fluoride, pyridine-HF, with ammonium fluoride, or with triethylamine trihydrofluoride.

In some embodiments, in the system, the cleavable linker on the base comprises cleavable moiety including an azide, azido or azidomethyl group. In some embodiments, the cleavable moieties azide, azido and azidomethyl group are cleavable/removable with a phosphine compound. In some embodiments, the phosphine compound comprises a derivatized tri-alkyl phosphine moiety or a derivatized tri-aryl phosphine moiety. In some embodiments, the phosphine compound comprises Tris(2-carboxyethyl)phosphine (TCEP) or bis-sulfo triphenyl phosphine (BS-TPP) or Tri (hydroxyproyl)phosphine (THPP). In some embodiments, the cleaving agent comprises 4-dimethylaminopyridine (4-DMAP).

In some embodiments, in the system, the chain terminating moiety (e.g., at the sugar 2' and/or sugar 3' position) and the cleavable linker on the base have the same or different cleavable moieties. In some embodiments, the chain terminating moiety (e.g., at the sugar 2' and/or sugar 3' position) and the detectable reporter moiety linked to the base are chemically cleavable/removable with the same chemical agent. In some embodiments, the chain terminating moiety (e.g., at the sugar 2' and/or sugar 3' position) and the detectable reporter moiety linked to the base are chemically cleavable/removable with different chemical agents.

In some embodiments, the system comprises: one or more mutant polymerases and a nucleic acid duplex each comprising a nucleic acid template hybridized to a nucleic acid primer. In some embodiments, the one or more polymerases and the nucleic acid duplex further comprises a plurality of multivalent molecules. The one or more mutant polymerases may or may not be bound to the nucleic acid duplex. The one or more mutant polymerases may or may not be bound to one or more of the multivalent molecules. In some embodiments, the one or mutant polymerases is bound to the nucleic acid duplex comprising a nucleic acid template hybridized to a nucleic acid primer, thereby forming a complexed polymerase, and the system further comprises a plurality of multivalent molecules. In some embodiments, the mutant polymerases include one or more example mutant polymerase features discussed above.

Figure 14A:
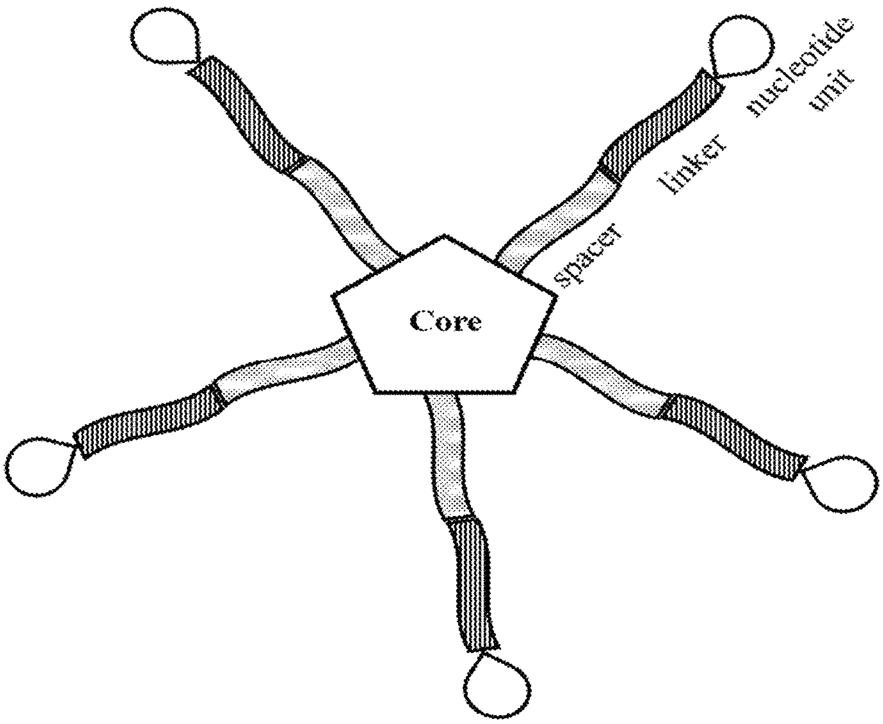
FIG. 14A is a schematic of a multivalent molecule comprising a generic core attached to a plurality of nucleotide-arms.
Figure 14B:
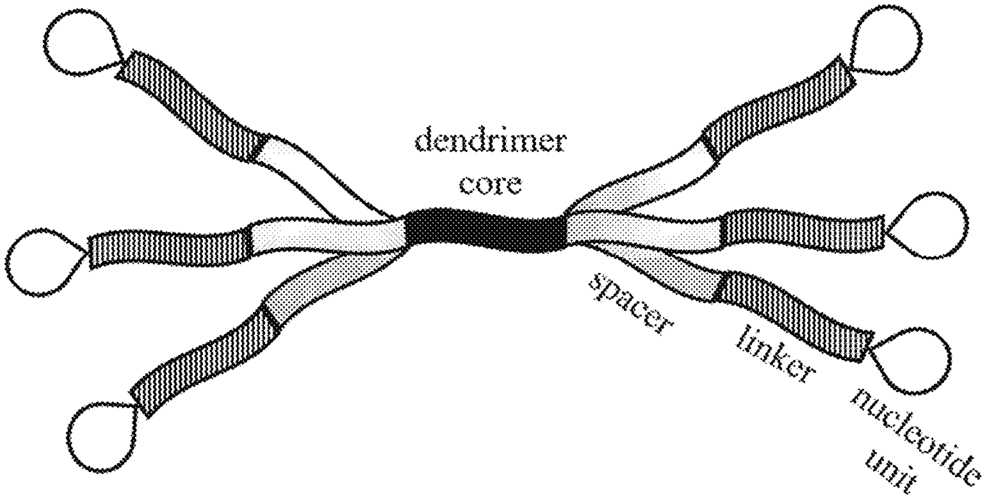
FIG. 14B is a schematic of a multivalent molecule comprising a dendrimer core attached to a plurality of nucleotide-arms.
Figure 15A:
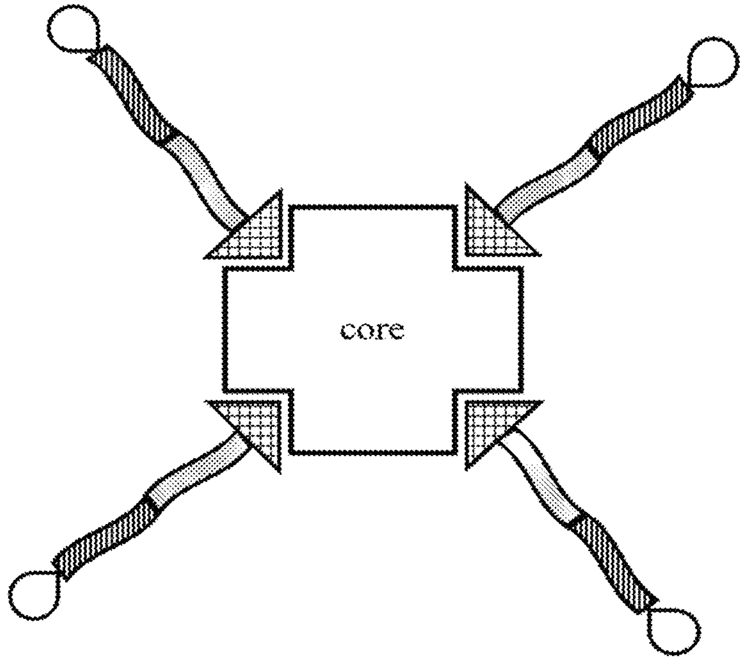
FIG. 15A shows a schematic of a multivalent molecule comprising a core attached to a plurality of nucleotide-arms, where the nucleotide arms comprise biotin, spacer, linker and a nucleotide unit.
Figure 15B:
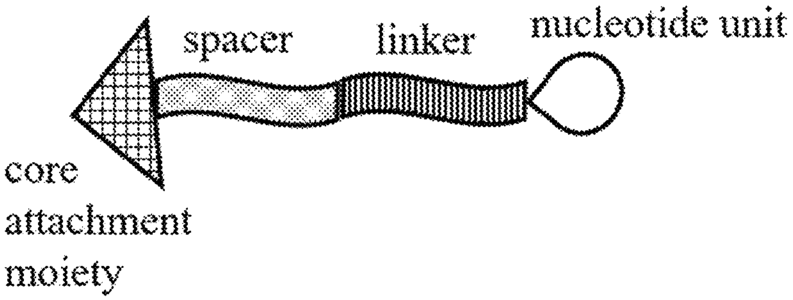
FIG. 15B is a schematic of a nucleotide-arm comprising a core attachment moiety, spacer, linker and nucleotide unit.
Figure 18:
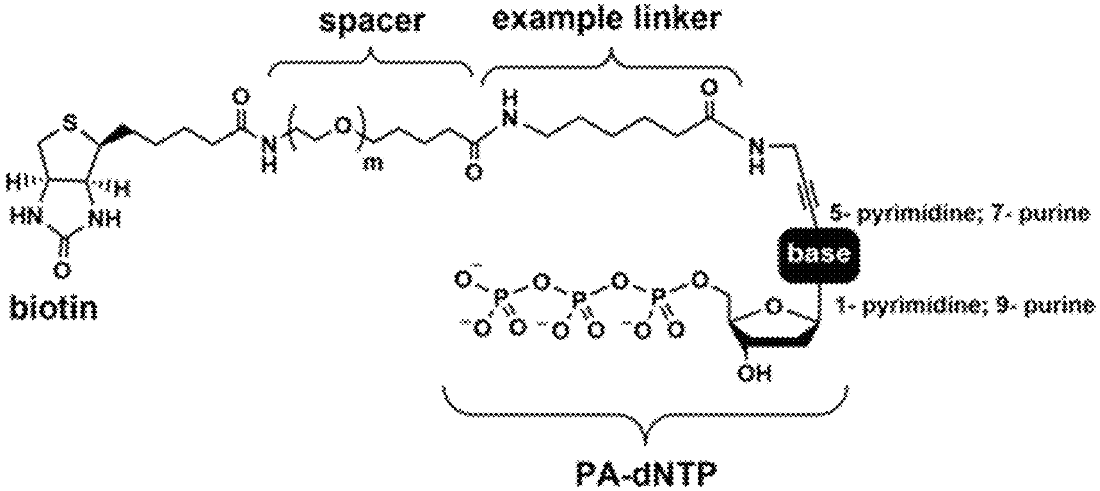
FIG. 18 shows the chemical structure of an exemplary nucleotide-arm. In this example, the nucleotide unit is connected to the linker via a propargyl amine attachment at the 5 position of a pyrimidine base or the 7 position of a purine base. This nucleotide-arm shows an exemplary biotinylated nucleotide-arm.

In some embodiments in the system, at least one multivalent molecule in the plurality of multivalent molecules comprises: (a) a core; and (b) a plurality of nucleotide arms which comprise (i) a core attachment moiety, (ii) a spacer comprising a PEG moiety, (iii) a linker, and (iv) a nucleotide unit, wherein the core is attached to the plurality of nucleotide arms, wherein the spacer is attached to the linker, wherein the linker is attached to the nucleotide unit. In some embodiments, the nucleotide unit comprises a base, sugar and at least one phosphate group, and the linker is attached to the nucleotide unit through the base. An exemplary spacer is shown in FIG. 16A (top). Various exemplary linkers are shown in FIG. 16A (bottom) and FIG. 16B. Examples of various linkers joined/attached to nucleotide units are shown in FIGS. 17A-17C, where the 5 position of a pyrimidine base or the 7 position of a purine base is attached to the linker via a propargyl amine attachment (see also FIG. 18). In some embodiments, the core comprises a streptavidin-type or avidin-type moiety and the core attachment moiety comprises biotin. In some embodiments, the linker comprises an aliphatic chain having 2-6 subunits or an oligo ethylene glycol chain having 2-6 subunits. In some embodiments, the linker further comprises an aromatic moiety. In some embodiments, the linker comprises an aliphatic chain or an oligo ethylene glycol chain where both linker chains having 2-6 subunits. In some embodiments, the linker also includes an aromatic moiety. An exemplary spacer is shown in FIG. 16A (top), and exemplary linkers are shown in FIGS. 16A (bottom) and 16B. An exemplary nucleotide arm is shown in FIG. 15B. Exemplary multivalent molecules are shown in FIGS. 14A, 14B and 15A. In some embodiments, the nucleotide unit comprises an aromatic base, a five carbon sugar and 1-10 phosphate groups. In some embodiments, the linker is attached to the nucleotide unit through the base. In some embodiments, the plurality of nucleotide arms attached to the core have the same type of a nucleotide unit, and wherein the types of nucleotide unit is selected from a group consisting of dATP, dGTP, dCTP, dTTP and dUTP. In some embodiments, the plurality of multivalent molecules comprise one type of a multivalent molecule wherein each multivalent molecule in the plurality has the same type of nucleotide unit selected from a group consisting of dATP, dGTP, dCTP, dTTP and dUTP. In some embodiments, the plurality of multivalent molecules comprise a mixture of any combination of two or more types of multivalent molecules each type having nucleotide units selected from a group consisting of dATP, dGTP, dCTP, dTTP and/or dUTP. One or more features described in this paragraph may appear in any example multivalent molecules in various embodiments described in this disclosure. The features described in this paragraph are referred to as "multivalent molecule embodiments" throughout this disclosure.

In some embodiments in the system, the nucleotide-arm is designed so that the nucleotide unit of the nucleotide-arm is capable of interacting with a polymerase enzyme in a manner similar to a free nucleotide. The nucleotide unit of a nucleotide-arm can bind a polymerase which is complexed with a nucleic acid template and nucleic acid primer (e.g., nucleotide association). The nucleotide unit can also dissociate from the complexed polymerase and either re-bind the same complexed polymerase or bind a different complexed polymerase that is proximal to the multivalent molecule. Since a multivalent molecule comprises multiple nucleotide-arms, the nucleotide units of a single multivalent molecule can bind multiple complexed polymerases at the same time. The multivalent molecules effectively increase the local concentration of nucleotides which can enhance signals in a nucleotide binding reaction.

In some embodiments in the system, a nucleotide unit of the multivalent molecule can bind to a complexed polymerase without incorporation. In some embodiments, a complementary nucleotide unit of a multivalent molecule can bind a complexed polymerase without undergoing polymerase-catalyzed incorporation in which the complementary nucleotide unit binds the 3' end of the primer at a position that is opposite a complementary nucleotide in the template strand.

In some embodiments in the system, a nucleotide unit of the multivalent molecule can bind to a complexed polymerase, and undergo primer extension by incorporating into the 3' end of an extendible primer (e.g., complexed with the polymerase) resulting in primer extension. When the nucleotide unit includes a sugar 3'OH then a subsequent nucleotide can be incorporated into the nascent extended primer. When the nucleotide unit includes a sugar 3'OH substituted with a blocking group, then a subsequent nucleotide is blocked from being incorporated into the nascent extended primer strand. A nucleotide unit (of a multivalent molecule) can bind the 3' end of the primer at a position that is opposite a complementary nucleotide in the template strand. The nucleotide unit can undergo nucleotide incorporation in a polymerase-catalyzed reaction, thereby extending the primer by one nucleotide.

In some embodiments in the system, the core unit of the multivalent molecule can be labeled with a detectable reporter moiety (e.g., fluorophore) in a manner that permits distinction between different multivalent molecules carrying a different type of nucleotide unit. For example, the core unit of a first multivalent molecule is labeled with a first fluorophore, where the first multivalent molecule comprises multiple nucleotide-arms with dGTP nucleotide units. The core unit of a second multivalent molecule is labeled with a second fluorophore (which differs from the first fluorophore), where the second multivalent molecule comprises multiple nucleotide-arms with dATP nucleotide units. The binding and incorporating events of the nucleotide unit can be detected, and the specific base of the nucleotide unit (as part of the multivalent molecule) can be identified based on detection and identification of the detectable reporter moiety on the core.

In some embodiments in the system, the core of the multivalent molecule can be labeled with a detectable reporter moiety (e.g., fluorophore) in a manner that permits distinction between different multivalent molecules carrying a different type of nucleotide unit. For example, the core of a first multivalent molecule is labeled with a first fluorophore, where the first multivalent molecule comprises multiple nucleotide-arms with dGTP nucleotide units. The core of a second multivalent molecule is labeled with a second fluorophore (which differs from the first fluorophore), where the second multivalent molecule comprises multiple nucleotide-arms with dATP nucleotide units. The binding and incorporating events of the nucleotide unit can be detected, and the specific base of the nucleotide unit (as part of the multivalent molecule) can be identified based on detection and identification of the detectable reporter moiety on the first and second core.

In some embodiments in the system, at least one linker of a nucleotide-arm of a multivalent molecule can be labeled with a detectable reporter moiety (e.g., fluorophore) in a manner that permits distinction between different multivalent molecules carrying a different type of nucleotide unit. For example, at least one linker of a first multivalent molecule is labeled with a first fluorophore, where the first multivalent molecule comprises multiple nucleotide-arms with dGTP nucleotide units. At least one linker of a second multivalent molecule is labeled with a second fluorophore (which differs from the first fluorophore), where the second multivalent molecule comprises multiple nucleotide-arms with dATP nucleotide units. The binding and incorporating events of the nucleotide units can be detected, and the specific base of the nucleotide unit (as part of the multivalent molecule) can be identified based on detection and identification of the detectable reporter moiety on the first and second linkers.

In some embodiments in the system, at least one nucleotide unit (e.g., nucleo-base) of a nucleotide-arm of a multivalent molecule can be labeled with a detectable reporter moiety (e.g., fluorophore) in a manner that permits distinction between different multivalent molecules carrying a different type of nucleotide unit. For example, at least one nucleotide unit of a first multivalent molecule is labeled with a first fluorophore, where the first multivalent molecule comprises multiple nucleotide-arms with dGTP nucleotide units. At least one nucleotide unit of a second multivalent molecule is labeled with a second fluorophore (which differs from the first fluorophore), where the second multivalent molecule comprises multiple nucleotide-arms with dATP nucleotide units. The binding and incorporating events of the nucleotide units can be detected, and the specific base of the nucleotide unit (as part of the multivalent molecule) can be identified based on detection and identification of the detectable reporter moiety on the first and second nucleotide units.

In some embodiments in the system, at least one nucleotide unit attached to the nucleotide arm of the multivalent molecule can be labeled with a detectable reporter moiety (e.g., fluorophore) in a manner that permits distinction between different multivalent molecules carrying a different type of nucleotide unit. For example, the nucleotide unit of a first multivalent molecule is labeled with a first fluorophore, where the first multivalent molecule comprises multiple nucleotide-arms with dGTP nucleotide units. The nucleotide unit of a second multivalent molecule is labeled with a second fluorophore (which differs from the first fluorophore), where the second multivalent molecule comprises multiple nucleotide-arms with dATP nucleotide units. The binding and incorporating events of the nucleotide unit can be detected, and the specific base of the nucleotide unit (as part of the multivalent molecule) can be identified based on detection and identification of the detectable reporter moiety on the nucleotide unit.

In some embodiments, in the system, individual multivalent molecules in the plurality of multivalent molecules comprise a core attached to multiple nucleotide arms, and wherein the multiple nucleotide arms have the same type of nucleotide unit which is selected from a group consisting of dATP, dGTP, dCTP, dTTP and dUTP.

In some embodiments, in the system, at least one multivalent molecule in the plurality of multivalent molecules comprise a nucleotide unit having a chain of one, two or three phosphorus atoms where the chain is typically attached to the 5' carbon of the sugar moiety via an ester or phosphoramide linkage. In some embodiments, at least one nucleotide unit is a nucleotide analog having a phosphorus chain in which the phosphorus atoms are linked together with intervening O, S, NH, methylene or ethylene. In some embodiments, the phosphorus atoms in the chain include substituted side groups including O, S or $BH_3$. In some embodiments, the chain includes phosphate groups (e.g., 1-10 phosphate groups) substituted with analogs including phosphoramidate, phosphorothioate, phosphorodithioate, and O-methylphosphoroamidite groups.

In some embodiments, in the system, individual multivalent molecules in the plurality of multivalent molecule comprise a core attached to multiple nucleotide arms, and wherein individual nucleotide arms comprise a nucleotide unit having a chain terminating moiety (e.g., blocking moiety) at the sugar 2' position, at the sugar 3' position, or at the sugar 2' and 3' position.

In some embodiments, in the system, at least one multivalent molecule in the plurality of multivalent molecules comprises a nucleotide unit comprising a nucleotide analog that includes one or more example nucleotide analog features discussed above.

In some embodiments, in the system, at least one multivalent molecule in the plurality of multivalent molecules comprises a nucleotide unit comprising a terminator nucleotide analog having a chain terminating moiety (e.g., blocking moiety) at the sugar 2' position, at the sugar 3' position, or at the sugar 2' and 3' position. The chain terminating moiety can be attached to the 3'—OH sugar position via a cleavable moiety, which may include any of the chain terminating moiety embodiments described above. In some embodiments the chain terminating moiety comprises an azide, azido, or azidomethyl group, including any of the potential features listed above.

In some embodiments, in the system, at least one multivalent molecule in the plurality of multivalent molecules comprises a core attached to multiple nucleotide arms, wherein the core is labeled with detectable reporter moiety. In some embodiments, the detectable reporter moiety comprises a fluorophore. The fluorophore which is attached to a given core corresponds to the nucleotide base (e.g., adenine, guanine, cytosine, thymine or uracil) of the nucleotide arm.

In some embodiments, in the system, at least one multivalent molecule in the plurality of multivalent molecules comprises a nucleotide unit attached to a nucleotide arm, wherein the linker and/or nucleotide unit is labeled with detectable reporter moiety. In some embodiments, the detectable reporter moiety comprises a fluorophore. The fluorophore which is attached to a given linker or nucleotide base corresponds to the nucleotide base (e.g., adenine, guanine, cytosine, thymine or uracil) of the nucleotide arm.

In some embodiments, in the system, the core comprises a streptavidin-type or avidin-type moiety and the core attachment moiety comprises biotin. In some embodiments, the core comprises a streptavidin-type or avidin-type moiety which includes an avidin protein, as well as any derivatives, analogs and other non-native forms of avidin that can bind to at least one biotin moiety. Other forms of avidin moieties include native and recombinant avidin and streptavidin as well as derivatized molecules, e.g. non-glycosylated avidin and truncated streptavidins. For example, avidin moiety includes de-glycosylated forms of avidin, bacterial streptavidin produced by *Streptomyces* (e.g., *Streptomyces avidinii*), as well as derivatized forms, for example, N-acyl avidins, e.g., N-acetyl, N-phthalyl and N-succinyl avidin, and the commercially-available products ExtrAvidin™, Captavidin™, Neutravidin™, and Neutralite Avidin™. An exemplary multivalent molecule is shown in FIG. 14A in which a generic core is conjugated to a plurality of nucleotide-arms. An exemplary design for a multivalent molecule is shown in FIG. 15A, which shows a core (e.g., streptavidin core) attached/bound to a plurality of nucleotide-arms, where the nucleotide arms comprise a core attachment moiety (e.g., biotin), spacer, linker and nucleotide unit. An exemplary biotinylated nucleotide-arm comprising biotin, spacer, linker and nucleotide unit, is shown in FIG. 15B.

In some embodiments, the system comprises: one or more mutant polymerases which are bound to nucleic acid duplexes each comprising a nucleic acid template hybridized to a nucleic acid primer, thereby forming a complexed polymerase, and the system further comprises at least one cation. In some embodiment, the at least one cation is selected from the group consisting of strontium, barium, sodium, magnesium, potassium, manganese, calcium, lithium, nickel and cobalt. In some embodiments, the cation comprises a catalytic divalent cation that promotes polymerase-catalyzed nucleotide incorporation, wherein the catalytic divalent cations comprise magnesium or manganese. In some embodiments, the cation comprises a non-catalytic divalent cation that inhibits polymerase-catalyzed nucleotide incorporation, wherein the non-catalytic divalent cations comprise strontium, barium and/or calcium.

In some embodiments, the system comprises: one or more mutant polymerases which are bound to nucleic acid duplexes each comprising a nucleic acid template molecule hybridized to a nucleic acid primer, thereby forming a complexed polymerase. In some embodiments, the nucleic acid template molecule comprises a linear nucleic acid molecule, or a circular nucleic acid molecule, or a mixture of both linear and circular nucleic acid molecules. In some embodiments, the nucleic acid template molecules in the plurality of nucleic acid template molecules comprise the same target sequence of interest or different target sequences of interest. In some embodiments, the nucleic acid template any of the potential features molecule comprises an amplified nucleic acid molecule. In some embodiments, the nucleic acid template molecule comprises a clonally-amplified template molecule or a single nucleic acid template molecule. In some embodiments, the nucleic acid template molecule comprises one copy of a target sequence of interest. In some embodiments, the nucleic acid template molecule comprises two or more tandem copies of a target sequence of interest (e.g., a concatemer). In some embodiments, the nucleic acid template molecules includes at least one uridine nucleotide or lacks a uridine nucleotide. In some embodiments, the primer provides an initiation site for nucleotide polymerization. In some embodiments, the nucleic acid primer comprises an extendible 3' terminal end or a non-extendible 3' terminal end. In some embodiments, the mutant polymerases include one or more example mutant polymerase features discussed above.

In some embodiments in the system, the complexed polymerase is immobilized to a support, where any of the nucleic acid template, nucleic acid primer and/or polymerase is/are immobilized to the support. In some embodiments, the system comprises a plurality of complexed polymerases immobilized to a support. In some embodiments, about $10^2$-$10^{15}$ complexed polymerases are immobilized to a support at different sites on the support. In some embodiments, the plurality of complexed polymerases are immobilized to pre-determined sites (e.g., locations) on the support. In some embodiments, the plurality of complexed polymerases are immobilized to random sites (e.g., locations) on the support. In some embodiments, the plurality of immobilized complexed mutant DNA polymerases are in fluid communication with each other to permit flowing a solution of reagents (e.g., enzymes including polymerases, multivalent molecules, nucleotides and/or divalent cations, and the like) onto the support so that the plurality of immobilized complexed polymerases on the support can be reacted with the solution of reagents in a massively parallel manner.

In some embodiments, in the system, the support comprises a planar or non-planar support. The support can be solid or semi-solid. In some embodiments, the support can be porous, semi-porous or non-porous. In some embodiments, the surface of the support can be coated with one or more compounds to produce a passivated layer on the support. In some embodiments, the passivated layer forms a porous or semi-porous layer. In some embodiments, the nucleic acid primer or template, or the polymerase, can be attached to the passivated layer to immobilize the primer, template and/or polymerase to the support. In some embodiments, the support comprises a low non-specific binding surface that enable improved nucleic acid hybridization and amplification performance on the support. In general, the support may comprise one or more layers of a covalently or non-covalently attached low-binding, chemical modification layers, e.g., silane layers, polymer films, and one or more covalently or non-covalently attached oligonucleotides that can be used for immobilizing a plurality of nucleic acid template molecules to the support. In some embodiments, the support can comprise a functionalized polymer coating layer covalently bound at least to a portion of the support via a chemical group on the support, a primer grafted to the functionalized polymer coating, and a water-soluble protective coating on the primer and the functionalized polymer coating. In some embodiments, the functionalized polymer coating comprises a poly(N-(5-azidoacet-amidylpentyl) acrylamide-co-acrylamide (PAZAM). In some embodiments, the support comprises a surface coating having at least one hydrophilic polymer coating layer and at least one layer of a plurality of oligonucleotides. The hydrophilic polymer coating layer can comprise polyethylene glycol (PEG). The hydrophilic polymer coating layer can comprise branched PEG having at least 4 branches. In some embodiments, the low non-specific binding coating has a water contact angle of no more than 45 degrees.

In some embodiments, in the system, the plurality of complexed DNA polymerases further comprise a first and second binding complex and a multivalent molecule which forms an avidity complex, wherein (i) the first binding complex comprises a first nucleic acid primer, a first DNA polymerase, and a first multivalent molecule bound to a first portion of a concatemer template molecule thereby forming a first binding complex, wherein a first nucleotide unit of the multivalent molecule is bound to the first DNA polymerase, and (ii) the second binding complex comprises a second nucleic acid primer, a second DNA polymerase, and the first multivalent molecule bound to a second portion of the same concatemer template molecule thereby forming a second binding complex, wherein a second nucleotide unit of the multivalent molecule is bound to the second DNA polymerase, wherein the first and second binding complexes which include the same multivalent molecule forms an avidity complex. In some embodiments, the first polymerase comprises any wild type or mutant polymerase described herein. In some embodiments, the second polymerase comprises any wild type or mutant polymerase described herein. The concatemer template molecule comprises tandem repeat sequences of a sequence of interest and at least one universal sequencing primer binding site. The first and second nucleic acid primers can bind to a sequencing primer binding site along the concatemer template molecule.

In some embodiments, in the system, the plurality of complexed DNA polymerases further comprise a first and second binding complex and a multivalent molecule which forms an avidity complex, wherein (i) the first binding complex comprises a first nucleic acid primer, a first DNA polymerase, and a first multivalent molecule bound to a first template molecule thereby forming a first binding complex, wherein a first nucleotide unit of the multivalent molecule is bound to the first DNA polymerase, and (ii) the second binding complex comprises a second nucleic acid primer, a second DNA polymerase, and the first multivalent molecule bound to a second template molecule thereby forming a second binding complex, wherein a second nucleotide unit of the multivalent molecule is bound to the second DNA polymerase, wherein the first and second binding complexes which include the same multivalent molecule forms an avidity complex. In some embodiments, the first polymerase comprises any wild type or mutant polymerase described herein. In some embodiments, the second polymerase comprises any wild type or mutant polymerase described herein. In some embodiments, the first and second template molecules are clonally amplified template molecules. In some embodiments, the first and second template molecules are localized in close proximity to each other. For example, the clonally-amplified first and second template molecules comprise linear template molecules that are generated via bridge amplification and are immobilized to the same location or feature on a support. The first and second template molecules comprise a sequence of interest and at least one universal sequencing primer binding site. The first and second nucleic acid primers can bind to a sequencing primer binding site on the first and second template molecules, respectively.

In some embodiments, the system comprises a reaction mixture which comprises: (a) one or more mutant polymerases; (b) a nucleic acid template molecule; (c) a nucleic acid primer having a 3' extendible end or a 3' non-extendible end; and (d) a plurality of nucleotides or a plurality of multivalent molecules. In some embodiments, the one or more mutant polymerases are not bound to the nucleic acid template molecules. In some embodiments, the one or more mutant polymerases are not bound to the nucleic acid primers. In some embodiments, the one or more mutant polymerases are bound to nucleic acid duplexes comprising a nucleic acid template hybridized to a nucleic acid primer, thereby forming complexed polymerases. In some embodiments, the nucleic acid template molecules includes at least one uridine nucleotide or lacks a uridine nucleotide. In some embodiments, the plurality of nucleotides includes at least one uridine nucleotide or lacks a uridine nucleotide. In some embodiments, the mutant polymerases include one or more example mutant polymerase features discussed above.

In some embodiments, the reaction mixture further comprises (e1) at least one non-catalytic divalent cation that permits binding at least one nucleotide to the complexed polymerase or that permits binding at least one multivalent molecule to the complexed polymerase, but the non-catalytic divalent cation inhibits polymerase-catalyzed incorporation. In some embodiments the non-catalytic divalent cation comprises strontium, barium and/or calcium.

In some embodiments, the reaction mixture further comprises (e2) at least one catalytic divalent cation that permits binding at least one nucleotide to the complexed polymerase or that permits binding at least one multivalent molecule to the complexed polymerase, and the catalytic divalent cation promotes polymerase-catalyzed incorporation. In some embodiments, the catalytic divalent cation comprises magnesium and/or manganese. In some embodiments, the nucleic acid template and nucleic acid primer are in solution.

In some embodiments, the nucleic acid template and/or the nucleic acid primer is immobilized to a support or immobilized to a coating on a support.

In some embodiments in the system, the reaction mixture is suitable for use in conducting a nucleotide binding reaction (or multivalent molecule binding reaction). In some embodiments, the reaction mixture is suitable for use in conducting a nucleotide incorporation reaction (or incorporation reaction of the nucleotide unit of the multivalent molecule). In some embodiments, the reaction mixture is suitable for use in conducting a primer extension reaction in which the nucleotide incorporates into the 3' end of the extendible primer (or the nucleotide unit of the multivalent molecule incorporates into the 3' end of the extendible primer).

In some embodiments, the system comprises a plurality of complexed polymerases, having at least a first and second complexed polymerase, wherein: (a) the first complexed polymerases comprises a first mutant polymerase bound to a first nucleic acid duplex comprising a first nucleic acid template molecule which is hybridized to a first nucleic acid primer, (b) the second complexed polymerases comprises a second mutant polymerase bound to a second nucleic acid duplex comprising a second nucleic acid template molecule which is hybridized to a second nucleic acid primer. In some embodiments, the first and second nucleic acid template molecule comprise the same or different sequences. In some embodiments, the first and second nucleic acid template molecules are clonally-amplified. In some embodiments, the first and/or the second nucleic acid template molecule includes at least one uridine nucleotide or lacks a uridine nucleotide. In some embodiments, the first and second primers comprise extendible 3' ends or non-extendible 3' ends. In some embodiments, the mutant polymerases include one or more example mutant polymerase features discussed above.

In some embodiments in the system, the plurality of complexed polymerases (including the first and second complexed polymerases) are immobilized to a support. In some embodiments, the density of the plurality of complexed polymerases comprises about $10^2$-$10^{15}$ per $mm^2$ complexed polymerases that are immobilized to the support. In some embodiments in the system, the first and second nucleic acid template molecules are immobilized to a different site on the support. In some embodiments, the support comprises a plurality of sites arranged in an array. In some embodiments, the sites on the support are arranged in one dimension in a row or a column, or arranged in two dimensions in rows and columns. In some embodiments, the plurality of sites is arranged on the support in a random or organized fashion, or a combination of both. In some embodiments, the plurality of sites is arranged in any pattern, including rectilinear or hexagonal patterns. In some embodiments, the support comprises about $10^2$-$10^{15}$ sites per $mm^2$ or more that are immobilized with nucleic acid templates to form a nucleic acid template array. In some embodiments, the nucleic acid templates that are immobilized at a plurality of sites, for example the nucleic acid template molecules are immobilized at about $10^2$-$10^{15}$ sites per $mm^2$ or more, where the immobilized nucleic acid templates are clonally-amplified to generate immobilized nucleic acid polonies at the plurality of sites. In some embodiment, the plurality of nucleic acid template molecules immobilized on the support are in fluid communication with each other to permit flowing a solution of a reagents (e.g., a plurality of enzymes (e.g., polymerases), a plurality of nucleotides and/or a plurality of multivalent molecules) onto the support so that the plurality of nucleic acid template molecules immobilized on the support can be reacted with the plurality of reagents in a massively parallel manner. In some embodiments, the fluid communication of the plurality of nucleic acid polonies immobilized on the support can be used to conduct nucleotide binding assays and/or conduct nucleotide incorporation assays (e.g., primer extension or sequencing) essentially simultaneously on the plurality of nucleic acid polonies. In some embodiments, the fluid communication of the plurality of nucleic acid polonies immobilized on the support can be used to conduct detection and imaging for massively parallel sequencing. In some embodiments, the term "immobilized" and related terms refer to nucleic acid molecules or enzymes that are attached directly to a support through covalent bond or non-covalent interaction, or attached to a coating on the support. In some embodiments, the coating comprises a low non-specific binding coating having a water contact angle of no more than 45 degrees.

Kits

The present disclosure provides a kit comprising a mutated polymerase as described herein. In some embodiments, the mutant polymerases include one or more example mutant polymerase features discussed above. In some embodiments, the mutant polymerases include one or more example mutant polymerase features discussed above. In some embodiments the kit further comprises at least one cation. In some embodiment, the at least one cation is selected from the group consisting of strontium, barium, sodium, magnesium, potassium, manganese, calcium, lithium, nickel and cobalt.

In some embodiments, the kit further comprises a plurality of nucleic acid primers having an extendible 3' terminal end or a non-extendible 3' terminal end. In some embodiments, at least one of the primers can be immobilized to a support. In some embodiments, the immobilized primers (e.g., capture primers) can be used to hybridize to nucleic acid templates. In some embodiments, at least one of the primers comprise a sequencing primer that can hybridize to an adaptor sequence (e.g., universal adaptor sequence) appended to a template molecule.

In some embodiments, the kit further comprises a plurality of nucleotide units as described above.

In some embodiments, in the system, or in the kit, can include, at least one nucleotide in the plurality of nucleotides comprise a chain of one, two or three phosphorus atoms where the chain is typically attached to the 5' carbon of the sugar moiety via an ester or phosphoramide linkage. In some embodiments, at least one nucleotide in the plurality is an analog having a phosphorus chain in which the phosphorus atoms are linked together with intervening O, S, NH, methylene or ethylene. In some embodiments, the phosphorus atoms in the chain include substituted side groups including O, S or $BH_3$. In some embodiments, the chain includes phosphate groups substituted with analogs including phosphoramidate, phosphorothioate, phosphorodithioate, and O-methylphosphoroamidite groups.

In some embodiments, in the system, or in the kit, at least one nucleotide in the plurality of nucleotides comprises a terminator nucleotide analog includes one or more example nucleotide analog features discussed above.

In some embodiments, in the system or in the kit, at least one nucleotide in the plurality of nucleotides comprises a terminator nucleotide analog having a chain terminating moiety (e.g., blocking moiety) at the sugar 2' position, at the sugar 3' position, or at the sugar 2' and 3' position. The chain terminating moiety can be attached to the 3'—OH sugar position via a cleavable moiety, which may include any of the chain terminating moiety embodiments described above. In some embodiments the chain terminating moiety comprises an azide, azido, or azidomethyl group, including any of the potential features listed above.

In some embodiments, in the system, or in the kit, the plurality of nucleotides comprises a plurality of nucleotides labeled with detectable reporter moiety, though it can also lack a detectable reporter moiety. The detectable reporter moiety comprises a fluorophore. In some embodiments, the fluorophore is attached to the nucleotide base. In some embodiments, the fluorophore is attached to the nucleotide base with a linker which is cleavable/removable from the base.

In some embodiments, in the kit, the chain terminating moiety (e.g., at the sugar 2' and/or sugar 3' position) and the cleavable linker on the base have the same or different cleavable moieties. In some embodiments, the chain terminating moiety (e.g., at the sugar 2' and/or sugar 3' position) and the detectable reporter moiety linked to the base are chemically cleavable/removable with the same chemical agent. In some embodiments, the chain terminating moiety (e.g., at the sugar 2' and/or sugar 3' position) and the detectable reporter moiety linked to the base are chemically cleavable/removable with different chemical agents.

The present disclosure provides a kit, or a system, that comprises at least one mutant polymerase comprising an amino acid sequence that is at least 80%, 85%, 90%, 95%, 99%, 99.1%, 99.2%, 99.3%, 99.4%, 99.5%, 99.6%, 99.7%, 99.8% identical, or a higher level sequence identity, to any of SEQ ID NOS: 1-268 or 288-375 or 385-397, and the kit further comprises a plurality of multivalent molecules, which may include any of the multivalent molecule embodiments, including any of the potential features listed above.

In some embodiments, in the system, or in the kit, at least one multivalent molecule in the plurality of multivalent molecules comprise a nucleotide unit having a chain of one, two or three phosphorus atoms where the chain is typically attached to the 5' carbon of the sugar moiety via an ester or phosphoramide linkage. In some embodiments, at least one nucleotide unit is a nucleotide analog having a phosphorus chain in which the phosphorus atoms are linked together with intervening O, S, NH, methylene or ethylene. In some embodiments, the phosphorus atoms in the chain include substituted side groups including O, S or $BH_3$. In some embodiments, the chain includes phosphate groups substituted with analogs including phosphoramidate, phosphorothioate, phosphorodithioate, and O-methylphosphoroamidite groups.

In some embodiments, in the system, or in the kit, can include individual multivalent molecules in the plurality of multivalent molecule comprise a core attached to multiple nucleotide arms, and wherein individual nucleotide arms comprise a nucleotide unit having a chain terminating moiety (e.g., blocking moiety) at the sugar 2' position, at the sugar 3' position, or at the sugar 2' and 3' position.

In some embodiments, in the system, or in the kit, at least one multivalent molecule in the plurality of multivalent molecules comprises a nucleotide unit comprising a terminator nucleotide analog that includes one or more example nucleotide analog features discussed above.

In some embodiments, in the system, or in the kit, can include at least one multivalent molecule in the plurality of multivalent molecules comprises a nucleotide unit comprising a terminator nucleotide analog having a chain terminating moiety (e.g., blocking moiety) at the sugar 2' position, at the sugar 3' position, or at the sugar 2' and 3' position. The chain terminating moiety can be attached to the 3'—OH sugar position via a cleavable moiety, which may include any of the chain terminating moiety embodiments described above. In some embodiments the chain terminating moiety comprises an azide, azido, or azidomethyl group, including any of the potential features listed above.

In some embodiments, in the system, or in the kit, at least one multivalent molecule in the plurality of multivalent molecules comprises a core attached to multiple nucleotide arms, wherein the core is labeled with detectable reporter moiety. In some embodiments, the detectable reporter moiety comprises a fluorophore. In some embodiments, in the kit, at least one multivalent molecule in the plurality of multivalent molecules comprises a core attached to multiple nucleotide arms, wherein at least one nucleotide-arm of a multivalent molecule includes a linker and/or base that is labeled with detectable reporter moiety. In some embodiments, the detectable reporter moiety comprises a fluorophore.

In some embodiments, in the system, or in the kit, individual multivalent molecules comprise a core having an avidin-like moiety and the core attachment moiety comprises biotin. In some embodiments, the core comprises an streptavidin-type or avidin-type moiety which includes an avidin protein, as well as any derivatives, analogs and other non-native forms of avidin that can bind to at least one biotin moiety. Other forms of avidin moieties include native and recombinant avidin and streptavidin as well as derivatized molecules, e.g. non-glycosylated avidin and truncated streptavidins. For example, avidin moiety includes de-glycosylated forms of avidin, bacterial streptavidin produced by *Streptomyces* (e.g., *Streptomyces avidinii*), as well as derivatized forms, for example, N-acyl avidins, e.g., N-acetyl, N-phthalyl and N-succinyl avidin, and the commercially-available products ExtrAvidin™, Captavidin™, Neutravidin™, and Neutralite Avidin™.

In some embodiments, in the system, or in the kit, comprise one or more containers that contain the at least one mutant polymerase, cations, primers, plurality of nucleotides and/or plurality of multivalent molecules. The mutant polymerase, cations, primers, and/or plurality of nucleotides can be combined in any combination and can be contained in a single container, or can be contained in separate container, or any combination thereof. The mutant polymerase, cations, primers, and/or plurality of multivalent molecules can be combined in any combination and can be contained in a single container, or can be contained in separate container, or any combination thereof.

The kit can include instructions for use of the kit for conducting a nucleotide binding reaction, a nucleotide incorporation reaction and/or a nucleic acid sequencing reaction using a plurality of nucleotides. The kit can include instructions for use of the kit for conducting a multivalent molecule binding reaction, a multivalent molecule incorporation reaction and/or a nucleic acid sequencing reaction using a plurality of multivalent molecules.

Nucleic Acids Encoding Mutant Polymerases, Vectors and Host Cells

The present disclosure provides nucleic acids encoding any of the mutant polymerases described herein which comprise an amino acid sequence that is at least 80%, 85%, 90%, 95%, 99%, 99.1%, 99.2%, 99.3%, 99.4%, 99.5%, 99.6%, 99.7%, 99.8% identical, or a higher level sequence identity, to any of SEQ ID NOS: 2-274 or 288-375 or 385-397.

The present disclosure provides a vector operably linked to at least one nucleic acid (e.g., a transgene) encoding any of the mutant polymerases described herein which comprise an amino acid sequence that is at least 80%, 85%, 90%, 95%, 99%, 99.1%, 99.2%, 99.3%, 99.4%, 99.5%, 99.6%, 99.7%, 99.8% identical, or a higher level sequence identity, to any of SEQ ID NOS: 2-274 or 288-375 or 385-397. In some embodiments, the vector comprises at least one host cell regulatory sequence, including a promoter sequence, enhancer, transcription and/or translation initiation sequence, transcription and/or translation termination sequence, polypeptide secretion signal sequences, and the like. The promoter sequence can be a constitutive or inducible promoter sequence. In some embodiments, the promoter sequence in the vector can be operably linked to the at least one nucleic acid encoding the mutant polymerase to control expression of the mutant polymerase by the host cell. In some embodiments, the vector comprises an expression vector.

The present disclosure provides a host cell harboring the vector (e.g., expression vector) which is operably linked to at least one nucleic acid (e.g., a transgene) encoding any of the mutant polymerases described herein which comprise an amino acid sequence that is at least 80%, 85%, 90%, 95%, 99%, 99.1%, 99.2%, 99.3%, 99.4%, 99.5%, 99.6%, 99.7%, 99.8% identical, or a higher level sequence identity, to any of SEQ ID NOS: 2-274 or 288-375 or 385-397. In some embodiments, the vector comprises a promoter sequence which is operably linked to the at least one nucleic acid encoding the mutant polymerase, where the promoter sequence controls expression of the mutant polymerase by the host cell.

The present disclosure provides a plurality of host cells, wherein individual host cells in the plurality of host cells harbor the vector (e.g., expression vector) which is operably linked to at least one nucleic acid (e.g., a transgene) encoding any of the mutant polymerases described herein which comprise an amino acid sequence that is at least 80%, 85%, 90%, 95%, 99%, 99.1%, 99.2%, 99.3%, 99.4%, 99.5%, 99.6%, 99.7%, 99.8% identical, or a higher level sequence identity, to any of SEQ ID NOS: 2-274 or 288-375 or 385-397. In some embodiments, the vector comprises a promoter sequence which is operably linked to the at least one nucleic acid encoding the mutant polymerase, where the promoter sequence controls expression of the mutant polymerase by the host cell.

Methods

The present disclosure provides methods for preparing a plurality of mutant polymerases, comprising: culturing the plurality of host cells of, wherein individual host cells in the plurality of host cells harbor the vector (e.g., expression vector) which is operably linked to at least one nucleic acid (e.g., a transgene) encoding any of the mutant polymerases described herein which comprise an amino acid sequence that is at least 80%, 85%, 90%, 95%, 99%, 99.1%, 99.2%, 99.3%, 99.4%, 99.5%, 99.6%, 99.7%, 99.8% identical, or a higher level sequence identity, to any of SEQ ID NOS: 2-274 or 288-375 or 385-397. In some embodiments, the vector in the host cell comprises a promoter sequence which is operably linked to the at least one nucleic acid encoding the mutant polymerase, where the promoter sequence controls expression of the mutant polymerase by the host cell. In some embodiments, the plurality of host cells is cultured under conditions suitable for expressing a plurality of mutant polymerases by the plurality of host cells. In some embodiments, the method further comprises recovering (e.g., isolating/enriching) the plurality of mutant polymerases from the plurality of host cells.

Provided herein are compositions and methods for the incorporation of modified nucleotides into a nucleic acid chain. Polymerases variously comprise DNA polymerases, RNA polymerases, template-independent polymerases, reverse transcriptases, or other enzymes capable of nucleotide extension. Wild type DNA polymerases generally do not tolerate certain types of nucleotide modifications, such as modifications to the 3' position of the sugar. This property requires that wild type DNA polymerases be significantly modified in order to facilitate reversible or irreversible terminator (removable chemical groups which prevent nucleic acid extension) incorporation for applications such as sequencing. Further provided herein are methods of sequencing employing mutant polymerases that incorporate modified nucleotides. Further, the use of engineered DNA polymerases allows the development of enzymes capable of incorporating modified nucleotides into an elongating nucleic acid chain without sacrificing the thermostability of the enzyme or the ability of the enzyme to function at higher temperatures. This property is especially enhanced when DNA polymerases are engineered based on archaeal polymerase backbones, and more especially backbones derived from the DNA polymerase sequences of thermophilic or thermotolerant archaea. The engineered polymerases may take the form of one or more polymerases described herein.

Thermostable and/or high fidelity engineered DNA polymerases may be useful in isothermal sequencing or elongation techniques. Isothermal techniques include SDA, LAMP, SMAP, ICAN, SMART, among others, and may further include additional techniques as disclosed herein. In these techniques, the elongation reaction proceeds at a constant temperature, for example using strand displacement reactions, or in some additional exemplary embodiments, elongating from a primed, single stranded template, especially including a primed polyvalent template. In some embodiments, the engineered DNA polymerases have strand displacement capabilities. In amplification-dependent methods, isothermal amplification can be completed in a single step, by incubating the mixture of samples, primers, DNA polymerase with strand displacement activity, and substrates at a constant temperature. This reduces the number of steps required, eliminating thermal ramping steps and reducing the total cycle time for each sequencing or elongation cycle, while simultaneously decreasing the reaction time required for each cycle. In amplification-free methods, isothermal methods allow for the binding, detection, and elongation of a nascent nucleic acid strand during a sequencing cycle without lost time due to temperature ramping or additional thermal stress on key components or reagents.

DNA polymerases which may be used according to the methods and compositions of the present disclosure include viral, bacterial, archaeal and eukaryotic polymerases and homologs and orthologs thereof. In some embodiments, DNA polymerases include but are not limited to archaeal DNA polymerases such as Candidatus altiarchaeales archaeon DNA polymerase and homologs and orthologs thereof and engineered, mutated, and/or truncated variants thereof; prokaryotic DNA polymerases such as *Geobacillus stearothermophilus* polymerase (e.g., Bst polymerase), and homologs and orthologs thereof and engineered, mutated, and/or truncated variants thereof; *Sulfolobus* sp. Dpo4 polymerase, including *Sulfolobus shibatae* and *Sulfolobus solfataricus* Dpo4 polymerase and related Y-family polymerases and homologs and orthologs thereof and engineered, mutated, and/or truncated variants thereof, other thermostable polymerases such as Thermus aquaticus DNA polymerase and homologs and orthologs thereof and engineered, mutated, and/or truncated variants thereof, *Pyrococcus furiosus* DNA polymerase and homologs and orthologs thereof and engineered, mutated, and/or truncated variants thereof, and/or eukaryotic DNA polymerases such as *Saccharomyces cerevisiae* PolB or Homo Sapiens PolB or other eukaryotic X-family polymerases and homologs and orthologs thereof and engineered, mutated, and/or truncated variants thereof. Other DNA polymerases and homologous or orthologous polymerases are known in the art and are expressly contemplated within this disclosure.

Provided herein are compositions and methods comprising mutant polypeptides which have enhanced thermostability. In some embodiments, such mutant polypeptides possess polymerase activity (e.g., mutant nucleic acid polymerase). Thermostability in some embodiments includes increased Tm, resistance to degradation, and/or the ability to maintain functional activity (e.g., incorporation of nucleotides) at elevated temperatures relative to a nearest wild-type enzyme, such as a wild-type enzyme comprising a nearest wild-type enzyme sequence. Mutant polymerases in some embodiments comprise Tm that are increased about 1, 2, 5, 10, 15, 20, 25, or about 30 degrees C. relative to a nearest wild-type enzyme. Mutant polypeptides in some embodiments comprise a Tm that are increased at least 1, 2, 5, 10, 15, 20, 25, or at least 30 degrees C. relative to a nearest wild-type enzyme. Mutant polymerases often comprise a Tm value that are increased at least 1-10, 5-15, 4-20, 2-10, 4-15, 20-30, 10-60, or 25-35 degrees C. relative to a nearest wild-type enzyme. Polymerase activity, in some embodiments, comprises $k_{cat}$, $k_{cat}/K_m$, or yields of incorporated nucleotides for a given time period. In some embodiments, polymerase activity, in some embodiments, comprises $k_{cat}$, $k_{cat}/K_m$, or yields of incorporated modified nucleotides, such as 3'-O-azidomethyl modified nucleotides, for a given time period. In some embodiments, mutant polymerases functioning at an elevated temperature maintain at least 99%, 98%, 95%, 90%, 85%, or at least 80% of the optimal activity of a nearest wild-type enzyme functioning at a lower temperature, utilizing unmodified nucleotides. For example, mutant polymerases functioning at about 37 degrees C. maintain at least 99%, 98%, 95%, 90%, 85%, or at least 80% of the optimal activity of a nearest wild-type enzyme utilizing unmodified nucleotides. In some embodiments, mutant polymerases functioning at about 42 degrees C. maintain at least 99%, 98%, 95%, 90%, 85%, or at least 80% of the optimal activity of a nearest wild-type enzyme utilizing unmodified nucleotides. In some embodiments, mutant polymerases functioning at about 55 degrees C. maintain at least 99%, 98%, 95%, 90%, 85%, or at least 80% of the optimal activity of a nearest wild-type enzyme utilizing unmodified nucleotides. In some embodiments, mutant polymerases functioning at about 60 degrees C. maintain at least 99%, 98%, 95%, 90%, 85%, or at least 80% of the optimal activity of a nearest wild-type enzyme utilizing unmodified nucleotides. In some embodiments, mutant polymerases functioning at least at 50 degrees C. maintain at least 99%, 98%, 95%, 90%, 85%, or at least 80% of the optimal activity of a nearest wild-type enzyme utilizing unmodified nucleotides. In some embodiments, mutant polymerases functioning at least at 60 degrees C. maintain at least 99%, 98%, 95%, 90%, 85%, or at least 80% of the optimal activity of a nearest wild-type enzyme utilizing unmodified nucleotides. In some embodiments, mutant polymerases functioning at 37-95 degrees C. maintain at least 99%, 98%, 95%, 90%, 85%, or at least 80% of the optimal activity of a nearest wild-type enzyme utilizing unmodified nucleotides. In some embodiments, mutant polymerases functioning at 37-95, 37-60, 37-55, 37-42, 40-60, 50-80, 42-55, 55-60, 55-95, 60-95, or 40-80 degrees C. maintain at least 99%, 98%, 95%, 90%, 85%, or at least 80% of the optimal activity of a nearest wild-type enzyme utilizing unmodified nucleotides. In some embodiments, mutant polymerases functioning at 42-95 degrees C. maintain at least 99%, 98%, 95%, 90%, 85%, or at least 80% of the optimal activity of a nearest wild-type enzyme utilizing unmodified nucleotides. In some embodiments, mutant polymerases functioning at 40-80 degrees C. maintain at least 99%, 98%, 95%, 90%, 85%, or at least 80% of the optimal activity of a nearest wild-type enzyme utilizing unmodified nucleotides. In some embodiments, mutant polymerases functioning at 37-55 degrees C. maintain at least 99%, 98%, 95%, 90%, 85%, or at least 80% of the optimal activity of a nearest wild-type enzyme utilizing unmodified nucleotides. In some embodiments, mutant polymerases functioning at 50-95 degrees C. maintain at least 99%, 98%, 95%, 90%, 85%, or at least 80% of the optimal activity of a nearest wild-type enzyme utilizing unmodified nucleotides. In some embodiments, Mutant polymerases functioning at 60-95 degrees C. maintain at least 99%, 98%, 95%, 90%, 85%, or at least 80% of the optimal activity of a nearest wild-type enzyme utilizing unmodified nucleotides.

In some embodiments a mutant polymerase has an increased $k_{cat}$ relative to a nearest related wild-type sequence functioning at a temperature of at least 37 degrees C. In some embodiments a mutant polymerase has an increased $k_{cat}$ relative to a nearest related wild-type sequence functioning at a temperature of at least 42 degrees C. In some embodiments a mutant polymerase has an increased $k_{cat}$ relative to a nearest related wild-type sequence functioning at a temperature of at least 55 degrees C. In some embodiments a mutant polymerase has an increased $k_{cat}$ relative to a nearest related wild-type sequence functioning at a temperature of at least 60 degrees C. In some embodiments a mutant polymerase has an increased $k_{cat}$ relative to a nearest related wild-type sequence functioning at a temperature of at least 80 degrees C. In some embodiments a mutant polymerase has an increased $k_{cat}$ relative to a nearest related wild-type sequence functioning at a temperature of at least 90 degrees C. In some embodiments a mutant polymerase has an increased $k_{cat}$ relative to a nearest related wild-type sequence functioning at a temperature of 37-95, 37-60, 37-55, 37-42, 40-60, 50-80, 42-55, 55-60, 55-95, 60-95, or 40-80 degrees C. In some embodiments a mutant polymerase has an increased $k_{cat}$ relative to a nearest related wild-type sequence functioning at a temperature of 37-55 degrees C. In some embodiments a mutant polymerase has an increased $k_{cat}$ relative to a nearest related wild-type sequence functioning at a temperature of 35-80 degrees C.

Provided herein are compositions and methods comprising mutant polypeptides relating to enzymes exhibiting increased capability for incorporation of modified nucleotides that are modified at the sugar 2' and/or 3' positions with for example a chain terminating moiety (e.g., blocking group/moiety). Exemplary modified nucleotides include any modification for reducing or inhibiting incorporation so additional (e.g., subsequent) nucleotides into a growing nucleic acid strand during nucleic acid synthesis, after incorporation of said nucleotide (often referred to as a "terminator" nucleotide). The chain terminating moiety may include any of the potential features of chain terminating moiety embodiments listed above. Other forms of 3' modified or "terminator" nucleotides are possible. In some embodiments, the present disclosure provides said composition wherein at least one nucleotide or nucleotide analog is a nucleotide that has not been modified at the sugar 2' or 3' position.

In some embodiments the present disclosure provides a method of utilizing the engineered polymerase variant disclosed herein in a method of determining the identity of a nucleotide in a target nucleic acid comprising the steps, without regard to any particular order of operations, 1) providing a composition comprising: a target nucleic acid comprising two or more repeats of an identical sequence; two or more primer nucleic acids complementary to one or more regions of said target nucleic acid; and two or more polymerase molecules; 2) contacting said composition with a multivalent binding composition comprising a polymer-nucleotide conjugate under conditions sufficient to allow a binding complex to be formed between said polymer-nucleotide conjugate and the composition of step (a), wherein the polymer-nucleotide conjugate comprises two or more copies of a nucleotide and optionally one or more detectable labels; and 3) detecting said binding complex, thereby establishing the identity of said nucleotide in the target nucleic acid polymer. In some further embodiments, the present disclosure provides said method, wherein the target nucleic acid is DNA, and/or wherein the target nucleic acid has been replicated, such as by any commonly practiced method of DNA replication or amplification, such as rolling circle amplification, bridge amplification, helicase dependent amplification, isothermal bridge amplification, rolling circle multiple displacement amplification (RCA/MDA) and/or recombinase based methods of replication or amplification. In some further embodiments, the present disclosure provides said method, wherein the detectable label is a fluorescent label and/or wherein detecting the complex comprises a fluorescence measurement. In some further embodiments, the present disclosure provides said method wherein the multivalent binding composition comprises one type of polymer-nucleotide conjugate, wherein the multivalent binding composition comprises two or more types of polymer-nucleotide conjugates, and/or wherein each type of the two or more types of polymer-nucleotide conjugates comprises a different type of nucleotide. In some embodiments, the present disclosure provides said method wherein the binding complex further comprises a blocked nucleotide, especially wherein the blocked nucleotide comprises a 3'-O-azidomethyl, a 3'-O-alkyl hydroxylamino or 3'-O-methyl nucleotide. In some further embodiments, the present disclosure provides said method wherein the contacting is done in the presence of strontium ions, barium ions, magnesium ions, and/or calcium ions. In some embodiments, the present disclosure provides said method wherein the polymerase molecule is catalytically inactive, such as where the polymerase molecule been rendered catalytically inactive by mutation, by chemical modification, or by the absence of a necessary ion or cofactor. In some embodiments, the present disclosure also provides said method wherein the polymerase molecule is catalytically active, and/or wherein the binding complex does not comprise a blocked nucleotide. In some embodiments, the present disclosure provides said method wherein the binding complex has a persistence time of greater than about 0.1, 0.2, 0.3, 0.4, 0.5, 0.6, 0.7, 0.8, 0.9 or 1 second. In some embodiments, the present disclosure provides said method wherein the binding complex has a persistence time of greater than about 0.1-0.25 seconds, or about 0.25-0.5 seconds, or about 0.5-0.75 seconds, or about 0.75-1 second, or about 1-2 seconds, or about 2-3 seconds, or about 3-4 second, or about 4-5 seconds, and/or wherein the method is or may be carried out at a temperature of at or above 15° C., at or above 20° C., at or above 25° C., at or above 35° C., at or above 37° C., at or above 42° C. at or above 55° C. at or above 60° C., or at or above 72° C., or within a range defined by any of the foregoing. The binding complex can remain stable until subjected to a condition that causes dissociation of interactions between any of the polymerase, template molecule, primer and/or the nucleotide unit or the nucleotide. For example, a dissociating condition comprises contacting the binding complex with any one or any combination of a detergent, EDTA and/or water. In some embodiments, the present disclosure provides said method wherein the binding complex is deposited on, attached to, or hybridized to, a surface showing a contrast to noise ratio in the detecting step of greater than 20. In some embodiments, the present disclosure provides said method wherein the composition is deposited under buffer conditions incorporating a polar aprotic solvent. In some embodiments, the present disclosure provides said method wherein the contacting is performed under a condition that stabilizes said binding complex when said nucleotide is complementary to a next base of said target nucleic acid, and destabilizes said binding complex when said nucleotide is not complementary to said next base of said target nucleic acid.

In some embodiments, the present disclosure provides said method wherein said polymer-nucleotide conjugate (e.g., multivalent molecule) comprises a polymer having a plurality of branches and said plurality of copies of said first nucleotide are attached to said branches (see FIGS. 14A and 14B, and 15A), especially wherein said first polymer has a star, comb, cross-linked, bottle brush, or dendrimer configuration. In some embodiments, the present disclosure provides said method wherein said polymer-nucleotide conjugate comprises one or more binding groups selected from the group consisting of avidin, biotin, affinity tag, and combinations thereof. In some embodiments, the present disclosure provides said method further comprising a dissociation step that destabilizes said binding complex formed between the composition of (a) and the polymer-nucleotide conjugate to remove said polymer-nucleotide conjugate. In some embodiments, the present disclosure provides said method further comprising an extension step to incorporate into said primer nucleic acid a nucleotide that is complementary to said next base of the target nucleic acid, and optionally wherein the extension step occurs currently as or after said dissociation step.

In some embodiments, the present disclosure provides a composition comprising a branched polymer having two or more branches and two or more copies of a nucleotide (e.g., multivalent molecule), wherein said nucleotide is attached to a first plurality of said branches or arms, and optionally, wherein one or more interaction moieties are attached to a second plurality of said branches or arms. In some embodiments, said composition may further comprise one or more labels on the polymer. In some embodiments, the present disclosure provides said composition wherein the nucleoside has a surface density of at least 4 nucleotides per polymer. In some embodiments, the present disclosure provides said composition comprising or incorporating a nucleotide or nucleotide analog that is modified so as to prevent its incorporation into an extending nucleic acid chain during a polymerase reaction. In some embodiments, said composition may comprise or incorporate a nucleotide or nucleotide analog that is reversibly modified so as to prevent its incorporation into an extending nucleic acid chain during a polymerase reaction. In some embodiments, the present disclosure provides said composition wherein one or more labels comprise a fluorescent label, a FRET donor, and/or a FRET acceptor. In some embodiments, said composition may comprise 2, 3, 4, 5, 6, 7, 8, 9, 10, 11, 12, 13, 14, 15, 16 or more branches or arms, or 2, 4, 8, 16, 32, 64, or more, branches or arms. In some embodiments, the branches or arms may radiate from a central moiety. In some embodiments, said composition may comprise one or more interaction moieties, which interaction moieties may comprise avidin or streptavidin; a biotin moiety; an affinity tag; an enzyme, antibody, minibody, receptor, or other protein; a non-protein tag; a metal affinity tag, or any combination thereof. In some embodiments, the present disclosure provides said composition wherein the polymer comprises polyethylene glycol, polypropylene glycol, polyvinyl acetate, polylactic acid, or polyglycolic acid. In some embodiments, the present disclosure provides said composition wherein the nucleotide or nucleotide analog is attached to the branch or arm through a linker; and especially wherein the linker comprises PEG, and wherein the PEG moiety has an average molecular weight of about 1K, about 2K, about 3K, about 4K, about 5K, about 10K, about 15K, about 20K, about 50K, about 100K, about 150K, or about 200K, or greater than about 200K. In some embodiments, the present disclosure provides said composition wherein the linker comprises PEG, and wherein the PEG moiety has an average molecular weight of between about 5K and about 20K. In some embodiments, the present disclosure provides said composition wherein at least one nucleotide or nucleotide analog comprises a deoxyribonucleotide, a ribonucleotide, a deoxyribonucleoside, or a ribonucleoside; and/or wherein the nucleotide or nucleotide analog is conjugated to the linker through the 5' end of the nucleotide or nucleotide analog. In some embodiments, the present disclosure provides said composition wherein one of the nucleotides or nucleotide analogs comprises deoxyadenosine, deoxyguanosine, thymidine, deoxyuridine, deoxycytidine, adenosine, guanosine, 5-methyl-uridine, and/or cytidine; and wherein the length of the linker is between 1 and 1,000 nm. In some embodiments, the present disclosure provides said composition wherein at least one nucleotide or nucleotide analog is a nucleotide that has been modified to inhibit elongation during a polymerase reaction or a sequencing reaction, such as wherein the at least one nucleotide or nucleotide analog is a nucleotide that lacks a 3' hydroxyl group; a nucleotide that has been modified to contain a blocking group at the 3' position; and/or a nucleotide that has been modified with a 3'-O-azido group, a 3'-O-azidomethyl group, a 3'-O-alkyl hydroxylamino group, a 3'O-phosphorothioate group, a 3'-O-malonyl group, or a 3'-O-benzyl group. In some embodiments, the present disclosure provides said composition wherein at least one nucleotide or nucleotide analog is a nucleotide that has not been modified at the 3' position.

In some embodiments, the present disclosure provides a method of determining the sequence of a nucleic acid molecule comprising the steps, without regard to any particular order, of 1) providing a mutant polymerase and a nucleic acid molecule comprising a template strand and a complementary strand that is at least partially complementary to the template strand; 2) contacting the nucleic acid molecule with the one or more nucleic acid binding compositions; 3) detecting binding of the nucleic acid binding composition to the nucleic acid molecule, and 4) determining an identity of a terminal nucleotide to be incorporated into said complementary strand of said nucleic acid molecule. In some embodiments, the present disclosure provides said method, further comprising incorporating said terminal nucleotide into said complementary strand, and repeating said contacting, detecting, and incorporating steps for one or more additional iterations, thereby determining the sequence of said template strand of said nucleic acid molecule. In some embodiments, the present disclosure provides said method, wherein said nucleic acid molecule is tethered to a solid support; and especially wherein the solid support comprises a glass or polymer substrate, at least one hydrophilic polymer coating layer, and a plurality of oligonucleotide molecules attached to at least one hydrophilic polymer coating layer. In some embodiments, the present disclosure provides said method, further comprising embodiments wherein at least one hydrophilic polymer coating layer comprises PEG; and/or wherein at least one hydrophilic polymer layer comprises a branched hydrophilic polymer having at least 8 branches. In some embodiments, the present disclosure provides said method, wherein the plurality of oligonucleotide molecules is present at a surface density of at least 500 molecules/$mm^2$, at least 1,000 molecules/$mm^2$, at least 5,000 molecules/$mm^2$, at least 10,000 molecules/$mm^2$, at least 20,000 molecules/$mm^2$, at least 50,000 molecules/$mm^2$, at least 100,000 molecules/$mm^2$, or at least 500,000 molecules/$mm^2$. In some embodiments, the present disclosure provides said method, wherein said nucleic acid molecule has been clonally-amplified on a solid support. In some embodiments, the present disclosure provides said method, wherein the clonal amplification comprises the use of a polymerase chain reaction (PCR), multiple displacement amplification (MDA), transcription-mediated amplification (TMA), nucleic acid sequence-based amplification (NASBA), strand displacement amplification (SDA), real-time SDA, bridge amplification, isothermal bridge amplification, rolling circle amplification, circle-to-circle amplification, helicase-dependent amplification, recombinase-dependent amplification, single-stranded binding (SSB) protein-dependent amplification, or any combination thereof. In some embodiments, the present disclosure provides said method, wherein the one or more nucleic acid binding compositions are labeled with fluorophores and the detecting step comprises use of fluorescence imaging; and especially wherein the fluorescence imaging comprises dual wavelength excitation/four wavelength emission fluorescence imaging. In some embodiments, the present disclosure provides said method, wherein four different nucleic acid binding compositions, each comprising a different nucleotide or nucleotide analog, are used to determine the identity of the terminal nucleotide, wherein the four different nucleic acid binding compositions are labeled with separate respective fluorophores, and wherein the detecting step comprises simultaneous or single excitation at a wavelength sufficient to excite all four fluorophores and imaging of fluorescence emission at wavelengths sufficient to detect each respective fluorophore. In some embodiments, the present disclosure provides said method, wherein four different nucleic acid binding compositions, each comprising a different nucleotide or nucleotide analog, are used to determine the identity of the terminal nucleotide, wherein the four different nucleic acid binding compositions are labeled with Cy3 or a dye or fluorophore similar in excitation or emission properties, Cy3.5 or a dye or fluorophore similar in excitation or emission properties, Cy5 or a dye or fluorophore similar in excitation or emission properties, and Cy5.5 or a dye or fluorophore similar in excitation or emission properties respectively, and wherein the detecting step comprises simultaneous excitation at any two of 532 nm, 568 nm and 633 nm, and imaging of fluorescence emission at about 570 nm, 592 nm, 670 nm, and 702 nm respectively; and/or wherein the fluorescence imaging comprises dual wavelength excitation/dual wavelength emission fluorescence imaging. In some embodiments, the present disclosure provides said method, wherein four different nucleic acid binding compositions, each comprising a different nucleotide or nucleotide analog, are used to determine the identity of the terminal nucleotide, wherein one, two, three, or four different nucleic acid binding compositions are respectively labeled, each with a with distinct fluorophore or set of fluorophores, and wherein the detecting step comprises simultaneous or single excitation at a wavelength sufficient to excite one, two, three, or four fluorophores or sets of fluorophores, and imaging of fluorescence emission at wavelengths sufficient to detect each respective fluorophore. In some embodiments, the present disclosure provides said method, wherein three different nucleic acid binding compositions, each comprising a different nucleotide or nucleotide analog, are used to determine the identity of the terminal nucleotide, wherein one, two, or three different nucleic acid binding compositions are respectively labeled, each with a with distinct fluorophore or set of fluorophores, and wherein the detecting step comprises simultaneous excitation at a wavelength sufficient to excite one, two, or three, fluorophores or sets of fluorophores, and imaging of fluorescence emission at wavelengths sufficient to detect each respective fluorophore, and wherein detection of the fourth nucleotide is determined or determinable with reference to the location of "dark" or unlabeled spots or target nucleotides. In some embodiments, the present disclosure provides said method, wherein the multivalent binding composition consists of three types of polymer-nucleotide conjugates and wherein each type of the three types of polymer-nucleotide conjugates comprises a different type of nucleotide. In some embodiments, the present disclosure provides said method, wherein the detection of the binding complex is performed in the absence of unbound or solution-borne polymer nucleotide conjugates.

In some embodiments, the present disclosure provides said method, wherein four different nucleic acid binding compositions, or three different nucleic acid binding compositions, each comprising a different nucleotide or nucleotide analog, are used to determine the identity of the terminal nucleotide, wherein one of the four or three different nucleic acid binding compositions is labeled with a first fluorophore, one is labeled with a second fluorophore, one is labeled with both the first and second fluorophore, and one is not labeled or is absent, and wherein the detecting step comprises simultaneous excitation at a first excitation wavelength and a second excitation wavelength and images are acquired at a first fluorescence emission wavelength and a second fluorescence emission wavelength. In some embodiments, the present disclosure provides said method, wherein the first fluorophore is Cy3 or a dye or fluorophore similar in excitation or emission properties, the second fluorophore is Cy5 or a dye or fluorophore similar in excitation or emission properties, the first excitation wavelength is 532 nm or 568 nm, the second excitation wavelength is 633 nm, the first fluorescence emission wavelength is about 570 nm, and the second fluorescence emission wavelength is about 670 nm. In some embodiments, the present disclosure provides said method, wherein the detection label can comprise one or more portions of a FRET pair, such that multiple classifications can be performed under a single excitation and imaging step. In some embodiments, the present disclosure provides said method, wherein a sequencing reaction cycle comprising the contacting, detecting, and incorporating/extending steps is performed in less than 30 minutes in less than 20 minutes, or in less than 10 minutes. In some embodiments, the present disclosure provides said method, wherein an average Q-score for base calling accuracy over a sequencing run is greater than or equal to 30, and/or greater than or equal to 40. In some embodiments, the present disclosure provides said method, wherein at least 50%, at least 60%, at least 70%, at least 80%, or at least 90% of the terminal nucleotides identified have a Q-score of greater than 30 and/or greater than or equal to 40. In some embodiments, the present disclosure provides said method, herein at least 95% of the terminal nucleotides identified have a Q-score of greater than 30.

In some embodiments, the present disclosure provides optionally, an engineered polymerase variant as disclosed herein, a reagent comprising one or more nucleic acid binding compositions as disclosed herein and a buffer. For example, in some embodiments, the present disclosure provides a reagent, wherein said reagent comprises 1, 2, 3, 4, or more nucleic acid binding compositions, wherein each nucleic acid binding composition comprises a single type of nucleotide. In some embodiments, a reagent of the present disclosure comprises 1, 2, 3, 4, or more nucleic acid binding compositions, wherein each nucleic acid binding composition comprises a single type of nucleotide or nucleotide analog, and wherein said nucleotide or nucleotide analog may respectively correspond to one or more from the group consisting of ATP, ADP, AMP, dATP, dADP, and dAMP; one or more from the group consisting of TTP, TDP, TMP, dTTP, dTDP, dTMP, UTP, UDP, UMP, dUTP, dUDP, and dUMP; one or more from the group consisting of CTP, CDP, CMP, dCTP, dCDP, and dCMP; and one or more from the group consisting of GTP, GDP, GMP, dGTP, dGDP, and dGMP. In some other examples or some further examples, the present disclosure provides a reagent comprising or further comprising 1, 2, 3, 4, or more nucleic acid binding compositions, wherein each nucleic acid binding composition comprises a single type of nucleotide or nucleotide analog, and wherein said nucleotide or nucleotide analog may respectively correspond to one or more from the group consisting of ATP, ADP, AMP, dATP, dADP, dAMP, TTP, TDP, TMP, dTTP, dTDP, dTMP, UTP, UDP, UMP, dUTP, dUDP, dUMP, CTP, CDP, CMP, dCTP, dCDP, dCMP, GTP, GDP, GMP, dGTP, dGDP, and dGMP.

In some embodiments, the present disclosure provides a system for performing the method or methods disclosed herein, comprising a polymerase variant as disclosed herein, a nucleic acid binding composition as disclosed herein, and/or a reagent as disclosed herein. In some embodiments, a system is configured to iteratively perform the sequential contacting of said tethered nucleic acid molecules with said nucleic acid binding composition and/or said reagent; and for the detection of binding of the nucleic acid binding compositions to the one or more nucleic acid molecules.

In some embodiments, the present disclosure provides a composition comprising an engineered polymerase variant as disclosed herein, and further comprising a particle, said particle comprising a plurality of enzyme or protein binding substrates, wherein the enzyme or protein binding substrates bind with one or more enzymes or proteins to form one or more binding complexes, and wherein said binding may be monitored or identified by observation of the location, presence, or persistence of one or more binding complexes. In some embodiments, said particle may comprise a polymer, branched polymer, dendrimer, liposome, micelle, nanoparticle, or quantum dot. In some embodiments, said substrate may comprise a nucleotide, a nucleoside, a nucleotide analog, or a nucleoside analog. In some embodiments, the enzyme or protein binding substrate may comprise an agent that can bind with a polymerase. In some embodiments, the enzyme or protein may comprise a polymerase, especially an engineered polymerase variant as disclosed herein. In some embodiments, said observation of the location, presence, or persistence of one or more binding complexes may comprise fluorescence detection. In some embodiments, the present disclosure provides a composition comprising multiple distinct particles as disclosed herein, wherein each particle comprises a single type of nucleoside or nucleoside analog, and wherein each nucleoside or nucleoside analog is associated with a fluorescent label of a detectably different emission or excitation wavelength. In some embodiments, the present disclosure provides said composition further comprising one or more labels on the particle. In some embodiments, the present disclosure provides said composition wherein the nucleoside or nucleoside analog has a surface density of at least 4 nucleosides or nucleoside analogs. In some embodiments, the present disclosure provides said composition wherein the nucleoside or nucleoside analog has a surface density of between 0.001 and 1,000,000 per $\mu m^2$, between 0.01 and 1,000,000 per $\mu m^2$, between 0.1 and 1,000,000 per $\mu m^2$, between 1 and 1,000,000 per $\mu m^2$, between 10 and 1,000,000 per $\mu m^2$, between 100 and 1,000,000 per $\mu m^2$, between 1,000 and 1,000,000 per $\mu m^2$, between 1,000 and 100,000 per $\mu m^2$, between 10,000 and 100,000 per $\mu m^2$, or between 50,000 and 100,000 per $\mu m^2$, or within a range defined by nay two of the foregoing values. In some embodiments, the present disclosure provides said composition wherein the nucleoside or nucleoside analog is present within a nucleotide or nucleotide analog. In some embodiments, the present disclosure provides said composition wherein the composition comprises or incorporates a nucleotide or nucleotide analog that is modified so as to prevent its incorporation into an extending nucleic acid chain during a polymerase reaction. In some embodiments, the present disclosure provides said composition wherein the composition comprises or incorporates a nucleotide or nucleotide analog that is reversibly modified so as to prevent its incorporation into an extending nucleic acid chain during a polymerase reaction. In some embodiments, the present disclosure provides said composition wherein one or more labels comprise a fluorescent label, a FRET donor, and/or a FRET acceptor. In some embodiments, the present disclosure provides said composition wherein the substrate is attached to the particle through a linker. In some embodiments, the present disclosure provides said composition wherein at least one nucleotide or nucleotide analog is a nucleotide that has been modified to inhibit elongation during a polymerase reaction or a sequencing reaction, such as, for example, a nucleotide that lacks a 3' hydroxyl group; a nucleotide that has been modified to contain a blocking group at the 3' position; a nucleotide that has been modified with a 3'-O-azido group, a 3'-O-azidomethyl group, a 3'-O-alkyl hydroxylamino group, a 3'-phosphorothioate group, a 3'-O-malonyl group, or a 3'-O-benzyl group; and/or a nucleotide that has not been modified at the 3' position.

In some embodiments, the present disclosure provides a method of determining the sequence of a nucleic acid molecule comprising the steps, without regard to order, of 1) providing a nucleic acid molecule comprising a template strand and a complementary strand that is at least partially complementary to the template strand; 2) contacting the nucleic acid molecule with an engineered polymerase variant as disclosed herein and one or more nucleic acid binding composition; 3) detecting binding of the nucleic acid binding composition to the nucleic acid molecule, and 4) determining an identity of a terminal nucleotide to be incorporated into said complementary strand of said nucleic acid molecule. In some embodiments, said method may further comprise incorporating said terminal nucleotide into said complementary strand, and repeating said contacting, detecting, and incorporating steps for one or more additional iterations, thereby determining the sequence of said template strand of said nucleic acid molecule. In some embodiments, the present disclosure provides said method wherein said nucleic acid molecule has been clonally-amplified on a solid support. In some embodiments, the present disclosure provides said method wherein the clonal amplification comprises the use of a polymerase chain reaction (PCR), multiple displacement amplification (MDA), transcription-mediated amplification (TMA), nucleic acid sequence-based amplification (NASBA), strand displacement amplification (SDA), real-time SDA, bridge amplification, isothermal bridge amplification, rolling circle amplification, circle-to-circle amplification, helicase-dependent amplification, recombinase-dependent amplification, single-stranded binding (SSB) protein-dependent amplification, or any combination thereof. In some embodiments, the present disclosure provides said method wherein a sequencing reaction cycle comprising the contacting, detecting, and incorporating steps is performed in less than 30 minutes, less than 20 minutes, or in less than 10 minutes. In some embodiments, the present disclosure provides said method wherein an average Q-score for base calling accuracy over a sequencing run is greater than or equal to 30, or greater than or equal to 40. In some embodiments, the present disclosure provides said method wherein at least 50%, at least 60%, at least 70%, at least 80%, or at least 90% of the terminal nucleotides identified have a Q-score of greater than 30; or greater than 40. In some embodiments, the present disclosure provides said method wherein at least 95% of the terminal nucleotides identified have a Q-score of greater than 30.

In some embodiments, the present disclosure provides a reagent comprising one or more engineered polymerase variants as disclosed herein, and optionally one or more multivalent nucleic acid binding compositions as disclosed herein.

In some embodiments, the present disclosure provides a kit comprising any of the compositions disclosed herein; and/or any of the reagents disclosed herein; one or more buffers; and instructions for the use thereof.

In some embodiments, the present disclosure provides a composition, or reagent, as disclosed herein for use in increasing the contrast to noise ratio (CNR) of a labeled nucleic acid complex bound to or associated with a surface.

In some embodiments, the present disclosure provides a composition, or reagent, as disclosed herein for use in establishing or maintaining control over the persistence time of a signal from a labeled nucleic acid complex bound to or associated with a surface.

In some embodiments, the present disclosure provides a composition, or reagent, as disclosed herein for use in establishing or maintaining control over the persistence time of a fluorescence, luminescence, electrical, electrochemical, colorimetric, radioactive, magnetic, or electromagnetic signal from a labeled nucleic acid complex bound to or associated with a surface.

In some embodiments, the present disclosure provides a composition, or reagent, as disclosed herein for use in increasing the specificity, accuracy, or read length of a nucleic acid sequencing and/or genotyping application or by binding, sequencing by synthesis, single molecule sequencing, or ensemble sequencing method.

The methods of determining the sequence of a target nucleic acid disclosed herein comprise: a) contacting a double-stranded or partially double-stranded target nucleic acid molecule comprising the template strand to be sequenced and a primer strand to be elongated with one or more of the disclosed nucleic acid binding compositions and one or more of the engineered polymerase variants; and b) detecting the binding of a nucleic acid binding composition to the nucleic acid molecule, thereby determining the presence of one of said one or more nucleic acid binding compositions on said nucleic acid molecule and the identity of the next nucleotide (i.e., the N+1 or terminal nucleotide) to be incorporated into the complementary strand.

The sequencing method may further comprise incorporating the N+1 or terminal nucleotide into the primer strand, and then repeating the contacting, detecting, and incorporating steps for one or more additional iterations, thereby determining the sequence of the template strand of the nucleic acid molecule. After the step of detecting the ternary binding complex, the primed strand of the primed target nucleic acid is extended for one base before another round of analysis is performed. The primed target nucleic acid can be extended using the conjugated nucleotide that is attached to the polymer in the multivalent binding composition, or using an unconjugated or untethered free nucleotide that is provided after the multivalent binding composition has been removed.

The extension of the primed target nucleic acid may be prevented or inhibited due to a blocked nucleotide (e.g., a 3' blocked nucleotide) on the strand or the use of polymerase that is catalytically inactive. When the nucleotide in the polymer-nucleotide conjugate has a blocking group that prevents the extension of the nucleic acid, incorporation of a nucleotide may be achieved by the removal of a blocking group from said nucleotide (such as by detachment of said nucleotide from its polymer, branched polymer, dendrimer, particle, or the like). When the extension of the primed target nucleic acid is inhibited due to the use of polymerase that is catalytically inactive, incorporation of a nucleotide may be achieved by the provision of a cofactor or activator such as a metal ion.

Detection of the ternary complex is achieved prior to, concurrently with, or following the incorporation of the nucleotide residue. In some embodiments, a primed target nucleic acid may comprise a target nucleic acid with multiple primed locations for the attachment of polymerases and/or nucleic acid binding moieties. In some embodiments, multiple polymerases may be attached to a single target nucleic acid molecule, such as at multiple sites within a target nucleic acid molecule. In some embodiments, multiple polymerases may be bound to a multivalent binding composition disclosed herein comprising multiple nucleotides. In some embodiments, a target nucleic acid molecule may be a product of a strand displacement synthesis, a rolling circle amplification, a concatenation or fusion of multiple copies of a query sequence, or other such methods as are known in the art or as are disclosed elsewhere herein to produce nucleic acid molecules comprising multiple copies of an identical sequence. Therefore, in some embodiments, multiple polymerases may be attached at multiple identical or substantially identical locations within a target nucleic acid which comprises multiple identical or substantially identical copies of a query sequence. In some embodiments, said multiple polymerases may then be involved in interactions with one or more multivalent binding complexes; however, in some embodiments, the number of binding sites within a target nucleic acid is at least two, and the number of nucleotides or substrate moieties present on a particle-nucleotide conjugate such as a polymer-nucleotide conjugate is also greater than or equal to two.

In some embodiments, the compositions and methods disclosed herein provide for engineered polymerase variants that may be used in the elongation of a nascent nucleic acid strand during synthesis and/or a sequencing reaction, as well as engineered polymerase variants that may be used in the detection of one or more bases during a sequencing reaction. In some embodiments, the present disclosure provides for the use of the disclosed polymerase variants in the incorporation of 3'-modified nucleotides into an elongating nucleic acid chain; in the elongation of a nascent nucleic acid chain, and/or in the detection or identification of a particular base within an elongating nucleic acid chain.

It may be advantageous to provide the multivalent binding compositions in combination with other elements such as to provide optimized signals, for example to provide identification of a nucleotide at a particular position in a nucleic acid sequence. In some embodiments, the compositions disclosed herein are provided in combination with a surface providing low background binding or low levels of protein binding, especially a hydrophilic or polymer coated surface. Representative surfaces may be found, for example, in U.S. patent application Ser. No. 16/363,842, filed Mar. 25, 2019, the contents of which are hereby incorporated by reference in their entirety.

In some embodiments, the nucleic acid molecule is tethered to the surface of a solid support, e.g., through hybridization of the template strand to an adapter nucleic acid sequence or primer nucleic acid sequence that is tethered to the solid support. In some embodiments, the solid support comprises a glass, fused-silica, silicon, or polymer substrate. In some embodiments, the solid support comprises a low non-specific binding coating comprising one or more hydrophilic polymer layers (e.g. PEG layers) where at least one of the hydrophilic polymer layers comprises a branched polymer molecule (e.g., a branched PEG molecule comprising 4, 8, 16, or 32 branches). In some embodiments, the low non-specific binding coating has a water contact angle of no more than 45 degrees.

The solid support comprises oligonucleotide adapters or primers tethered to at least one hydrophilic polymer layer at a surface density ranging from about 1,000 primer molecules per $\mu m^2$ to about 1,000,000 primer molecules per $\mu m^2$. In some embodiments, the surface density of oligonucleotide primers may be at least 1,000, at least 10,000, at least 100,000, or at least 1,000,000 molecules per $\mu m^2$. In some embodiments, the surface density of oligonucleotide primers may be at most 1,000,000, at most 100,000, at most 10,000, or at most 1,000 molecules per $\mu m^2$. Any of the lower and upper values described in this paragraph may be combined to form a range included within the present disclosure, for example, in some embodiments the surface density of primers may range from about 10,000 molecules per $\mu m^2$ to about 100,000 molecules per $\mu m^2$. Those of skill in the art will recognize that the surface density of primer molecules may have any value within this range, e.g., about 455,000 molecules per $\mu m^2$.

One of ordinary skill would recognize that in a series of iterative sequencing reactions, occasionally one or more sites will fail to incorporate a nucleotide during a given cycle, thus leading one or more sites to be unsynchronized with the bulk of the elongating nucleic acid chains. Under conditions in which sequencing signals are derived from reactions occurring on single copies of a target nucleic acid, these failures to incorporate will yield discrete errors in the output sequence. It is an object of the present disclosure to provide methods for reducing this type of error in sequencing reactions. For further example, the use of multivalent substrates that are capable of incorporation into the elongating strand, by providing increased probabilities of rebinding upon premature dissociation of a ternary polymerase complex, can reduce the frequency of "skipped" cycles in which a base is not incorporated. Thus, in some embodiments, the present disclosure contemplates the use of engineered polymerase variants as disclosed herein, either alone or in combination with multivalent substrates as disclosed herein. The present disclosure expressly contemplates embodiments comprising one or more engineered polymerase variants as disclosed herein and one or more multivalent binding substrates in which the nucleoside moiety is comprised within a nucleotide having a free, or reversibly modified, 5' phosphate, diphosphate, or triphosphate moiety, and wherein the nucleotide is connected to the particle or polymer as disclosed herein, through a labile or cleavable linkage. In some embodiments, the present disclosure contemplates a reduction in the intrinsic error rate due to skipped incorporations as a result of the use of the engineered polymerase variants and/or multivalent substrates disclosed herein.

The present disclosure also contemplates sequencing reactions in which sequencing signals from or relating to a given sequence are derived from or originate within definable regions containing multiple copies of the target sequence. Sequencing methods incorporating multiple copies of a target sequence have the advantage that signals can be amplified due to the presence of multiple simultaneous sequencing reactions within the defined region, each providing its own signal. The presence of multiple signals within a defined area also reduces the impact of any single skipped cycle, due to the fact that the signal from a large number of correct base calls can overwhelm the signal from a smaller number of skipped or incorrect base calls. The present disclosure further contemplates the inclusion of free, unlabeled nucleotides during elongation reactions, or during a separate part of the elongation cycle, in order to provide incorporation at sites that may have been skipped in previous cycles. For example, during or following an incorporation cycle, unlabeled blocked nucleotides may be added such that they may be incorporated at skipped sites. The unlabeled blocked nucleotides may be of the same type or types as the nucleotide attached to the multivalent binding substrate or substrates that are or were present during a particular cycle, or a mixture of 1, 2, 3, 4 or more types of unlabeled blocked nucleotides may be included.

When each sequencing cycle proceeds perfectly, each reaction within the defined region will provide an identical signal. However, as noted elsewhere herein, in a series of iterative sequencing reactions, occasionally one or more sites will fail to incorporate a nucleotide during a given cycle, thus leading one or more sites to be unsynchronized with the bulk of the elongating nucleic acid chains. This issue, referred to as "phasing," leads to degradation of the sequencing signal as the signal is contaminated with spurious signals from sites having skipped one or more cycles. This, in turn, creates the potential for errors in base identification. The progressive accumulation of skipped cycles through multiple cycles also reduces the effective read length, due to progressive degradation of the sequencing signal with each cycle. It is a further object of this disclosure to provide methods for reducing phasing errors and/or to improve read length in sequencing reactions.

The sequencing method can include contacting a target nucleic acid or multiple target nucleic acids, comprising multiple linked or unlinked copies of a target sequence, with the multivalent binding compositions described herein. Contacting said target nucleic acid, or multiple target nucleic acids comprising multiple linked or unlinked copies of a target sequence, with one or more particle-nucleotide conjugates may provide a substantially increased local concentration of the correct nucleotide being interrogated in a given sequencing cycle, thus suppressing signals from improper incorporations or phased nucleic acid chains (i.e., those elongating nucleic acid chains which have had one or more skipped cycles).

The method of obtaining nucleic acid sequence information can include contacting a target nucleic acid, or multiple target nucleic acids, wherein said template nucleic acid or multiple target nucleic acids comprise multiple linked or unlinked copies of a target sequence, with one or more particle-nucleotide conjugates. In some embodiments, this method results in an increase in average read length of 5%, 10%, 15%, 20% 25%, 50%, 75%, 100%, 150%, 200%, 300%, or more compared to the average read length observed using monovalent ligands, including free nucleotides, labeled free nucleotides, protein or peptide bound nucleotides, or labeled protein or peptide bound nucleotides. In some embodiments this method results in an increase in average read length of 10NT, 20NT, 25NT, 30NT, 50NT, 75NT, 100NT, 125NT, 150NT, 200NT, 250NT, 300NT, 350NT, 400NT, 500NT, or more compared to the average read length observed using wild type polymerases or currently available polymerase variants. monovalent ligands, including free nucleotides, labeled free nucleotides, protein or peptide bound nucleotides, or labeled protein or peptide bound nucleotides.

Methods of obtaining nucleic acid sequence information can include contacting a target nucleic acid, or multiple target nucleic acids, wherein said target nucleic acid or multiple target nucleic acids comprise multiple linked or unlinked copies of a target sequence, with one or more engineered polymerase variants, and optionally with one or more particle-nucleotide conjugates. This method results in a reduction in the error rate of sequencing as indicated by reduction in the misidentification of bases, the reporting of nonexistent bases, or the failure to report correct bases. In some embodiments, said reduction in the error orate of sequencing may comprise a reduction of 5%, 10%, 15%, 20% 25%, 50%, 75%, 100%, 150%, 200%, or more compared to the error rate observed using wild type enzymes or currently available enzymes, or monovalent ligands, including free nucleotides, labeled free nucleotides, protein or peptide bound nucleotides, or labeled protein or peptide bound nucleotides.

The use of engineered polymerase variants for sequencing provides a more accurate base readout. The disclosed compositions and methods for nucleic acid sequencing will provide an average Q-score for base-calling accuracy over a sequencing run that ranges from about 20 to about 50. In some embodiments, the average Q-score is at least 20, at least 25, at least 30, at least 35, at least 40, at least 45, or at least 50. Those of skill in the art will recognize that the average Q-score may have any value within this range, e.g., about 32.

In some embodiments, the disclosed compositions and methods for nucleic acid sequencing will provide a Q-score of greater than 30 for at least 50%, at least 60%, at least 70%, at least 80%, at least 85%, at least 90%, at least 95%, at least 98%, or at least 99% of the terminal (or N+1) nucleotides identified. In some embodiments, the disclosed compositions and methods for nucleic acid sequencing will provide a Q-score of greater than 35 for at least 50%, at least 60%, at least 70%, at least 80%, at least 85%, at least 90%, at least 95%, at least 98%, or at least 99% of the terminal (or N+1) nucleotides identified. In some embodiments, the disclosed compositions and methods for nucleic acid sequencing will provide a Q-score of greater than 40 for at least 50%, at least 60%, at least 70%, at least 80%, at least 85%, at least 90%, at least 95%, at least 98%, or at least 99% of the terminal (or N+1) nucleotides identified. In some embodiments, the disclosed compositions and methods for nucleic acid sequencing will provide a Q-score of greater than 45 for at least 50%, at least 60%, at least 70%, at least 80%, at least 85%, at least 90%, at least 95%, at least 98%, or at least 99% of the terminal (or N+1) nucleotides identified. In some embodiments, the disclosed compositions and methods for nucleic acid sequencing will provide a Q-score of greater than 50 for at least 50%, at least 60%, at least 70%, at least 80%, at least 85%, at least 90%, at least 95%, at least 98%, or at least 99% of the terminal (or N+1) nucleotides identified.

The disclosed low non-specific binding supports and associated nucleic acid hybridization and amplification methods may be used for the analysis of nucleic acid molecules derived from any of a variety of different cell, tissue, or sample types known to those of skill in the art. For example, nucleic acids may be extracted from cells, or tissue samples comprising one or more types of cells, derived from eukaryotes (such as animals, plants, fungi, protista), archaebacteria, or eubacteria. In some cases, nucleic acids may be extracted from prokaryotic or eukaryotic cells, such as adherent or non-adherent eukaryotic cells. Nucleic acids are variously extracted from, for example, primary or immortalized rodent, porcine, feline, canine, bovine, equine, primate, or human cell lines. Nucleic acids may be extracted from any of a variety of different cell, organ, or tissue types (e.g., white blood cells, red blood cells, platelets, epithelial cells, endothelial cells, neurons, glial cells, astrocytes, fibroblasts, skeletal muscle cells, smooth muscle cells, gametes, or cells from the heart, lungs, brain, liver, kidney, spleen, pancreas, thymus, bladder, stomach, colon, or small intestine). Nucleic acids may be extracted from normal or healthy cells. Alternately or in combination, acids are extracted from diseased cells, such as cancerous cells, or from pathogenic cells that are infecting a host. Some nucleic acids may be extracted from a distinct subset of cell types, e.g., immune cells (such as T cells, cytotoxic (killer) T cells, helper T cells, alpha beta T cells, gamma delta T cells, T cell progenitors, B cells, B-cell progenitors, lymphoid stem cells, myeloid progenitor cells, lymphocytes, granulocytes, Natural Killer cells, plasma cells, memory cells, neutrophils, eosinophils, basophils, mast cells, monocytes, dendritic cells, and/or macrophages, or any combination thereof), undifferentiated human stem cells, human stem cells that have been induced to differentiate, rare cells (e.g., circulating tumor cells (CTCs), circulating epithelial cells, circulating endothelial cells, circulating endometrial cells, bone marrow cells, progenitor cells, foam cells, mesenchymal cells, or trophoblasts). Other cells are contemplated and consistent with the disclosure herein.

In some embodiments the present disclosure provides method of determining the identity of a nucleotide in a target nucleic acid comprising the steps, without regard to any particular order of operations, 1) providing a composition comprising: a target nucleic acid comprising two or more repeats of an identical sequence; two or more primer nucleic acids complementary to one or more regions of said target nucleic acid; and two or more polymerase molecules, wherein said polymerase molecules may comprise one or more engineered polymerase variants as disclosed herein; 2) contacting said composition with a multivalent binding composition comprising a polymer-nucleotide conjugate under conditions sufficient to allow a binding complex to be formed between said polymer-nucleotide conjugate and the composition of step (a), wherein the polymer-nucleotide conjugate comprises two or more copies of a nucleotide and optionally one or more detectable labels; and 3) detecting said binding complex, thereby establishing the identity of said nucleotide in the target nucleic acid polymer. In some further embodiments, the present disclosure provides said method, wherein the target nucleic acid is DNA, and/or wherein the target nucleic acid has been replicated, such as by any commonly practiced method of DNA replication or amplification, such as rolling circle amplification, bridge amplification, helicase dependent amplification, isothermal bridge amplification, rolling circle multiple displacement amplification (RCA/MDA) and/or recombinase based methods of replication or amplification. In some further embodiments, the present disclosure provides said method, wherein the detectable label is a fluorescent label and/or wherein detecting the complex comprises a fluorescence measurement. In some further embodiments, the present disclosure provides said method wherein the multivalent binding composition comprises one type of polymer-nucleotide conjugate, wherein the multivalent binding composition comprises two or more types of polymer-nucleotide conjugates, and/or wherein each type of the two or more types of polymer-nucleotide conjugates comprises a different type of nucleotide. In some embodiments, the present disclosure provides said method wherein the binding complex further comprises a blocked nucleotide, especially wherein the blocked nucleotide is a 3'-O-azidomethyl, a 3'-O-alkyl hydroxylamino or 3'-O-methyl nucleotide. In some further embodiments, the present disclosure provides said method wherein the contacting is done in the presence of strontium ions, barium ions, magnesium ions, and/or calcium ions. In some embodiments, the present disclosure provides said method wherein the polymerase molecule is catalytically inactive, such as where the polymerase molecule been rendered catalytically inactive by mutation, by chemical modification, or by the absence of a necessary ion or cofactor. In some embodiments, the present disclosure also provides said method wherein the polymerase molecule is catalytically active, and/or wherein the binding complex does not comprise a blocked nucleotide. In some embodiments, the present disclosure provides said method wherein the binding complex has a persistence time of greater than about 0.1, 0.2, 0.3, 0.4, 0.5, 0.6, 0.7, 0.8, 0.9, 1 or 2 seconds and/or wherein the method is or may be carried out at a temperature of at or above 15° C., at or above 20° C., at or above 25° C., at or above 35° C., at or above 37° C., at or above 42° C. at or above 55° C. at or above 60° C., or at or above 72° C., or within a range defined by any of the foregoing. In some embodiments, the present disclosure provides said method wherein the binding complex is deposited on, attached to, or hybridized to, a surface showing a contrast to noise ratio in the detecting step of greater than 20. In some embodiments, the present disclosure provides said method wherein the composition is deposited under buffer conditions incorporating a polar aprotic solvent. In some embodiments, the present disclosure provides said method wherein the contacting is performed under a condition that stabilizes said binding complex when said nucleotide is complementary to a next base of said target nucleic acid, and destabilizes said binding complex when said nucleotide is not complementary to said next base of said target nucleic acid. In some embodiments, the present disclosure provides said method wherein said polymer-nucleotide conjugate comprises a polymer having a plurality of branches and said plurality of copies of said first nucleotide are attached to said branches, especially wherein said first polymer has a star, comb, cross-linked, bottle brush, or dendrimer configuration. In some embodiments, the present disclosure provides said method wherein said polymer-nucleotide conjugate comprises one or more binding groups selected from the group consisting of avidin, biotin, affinity tag, and combinations thereof. In some embodiments, the present disclosure provides said method further comprising a dissociation step that destabilizes said binding complex formed between the composition of (a) and the polymer-nucleotide conjugate to remove said polymer-nucleotide conjugate. In some embodiments, the present disclosure provides said method further comprising an extension step to incorporate into said primer nucleic acid a nucleotide that is complementary to said next base of the target nucleic acid, and optionally wherein the extension step occurs currently as or after said dissociation step. In some embodiments, the present disclosure provides a composition comprising a branched polymer having two or more branches and two or more copies of a nucleotide, wherein said nucleotide is attached to a first plurality of said branches or arms, and optionally, wherein one or more interaction moieties are attached to a second plurality of said branches or arms. In some embodiments, said composition may further comprise one or more labels on the polymer. In some embodiments, the present disclosure provides said composition wherein the nucleoside has a surface density of at least 4 nucleotides per polymer. In some embodiments, the present disclosure provides said composition comprising or incorporating a nucleotide or nucleotide analog that is modified so as to prevent incorporation of a subsequent nucleotide (or nucleotide analog) into an extending nucleic acid chain during a polymerase reaction. In some embodiments, said composition may comprise or incorporate a nucleotide or nucleotide analog that is reversibly modified so as to permit incorporation of a subsequent nucleotide (or nucleotide analog) into an extending nucleic acid chain during a polymerase reaction. In some embodiments, the present disclosure provides said composition wherein one or more labels comprise a fluorescent label, a FRET donor, and/or a FRET acceptor. In some embodiments, said composition may comprise 2, 3, 4, 5, 6, 7, 8, 9, 10, 11, 12, 13, 14, 15, 16 or more branches or arms, or 2, 4, 8, 16, 32, 64, or more, branches or arms. In some embodiments, the branches or arms may radiate from a central moiety. In some embodiments, said composition may comprise one or more interaction moieties, which interaction moieties may comprise avidin or streptavidin; a biotin moiety; an affinity tag; an enzyme, antibody, minibody, receptor, or other protein; a non-protein tag; a metal affinity tag, or any combination thereof. In some embodiments, the present disclosure provides said composition wherein the polymer comprises polyethylene glycol, polypropylene glycol, polyvinyl acetate, polylactic acid, or polyglycolic acid. In some embodiments, the present disclosure provides said composition wherein the nucleotide or nucleotide analog is attached to the branch or arm through a linker; and especially wherein the linker comprises PEG, and wherein the PEG moiety has an average molecular weight of about 1K, about 2K, about 3K, about 4K, about 5K, about 10K, about 15K, about 20K, about 50K, about 100K, about 150K, or about 200K, or greater than about 200K. In some embodiments, the present disclosure provides said composition wherein the linker comprises PEG, and wherein the PEG moiety has an average molecular weight of between about 5K and about 20K. In some embodiments, the present disclosure provides said composition wherein at least one nucleotide or nucleotide analog comprises a deoxyribonucleotide, a ribonucleotide, a deoxyribonucleoside, or a ribonucleoside; and/or wherein the nucleotide or nucleotide analog is conjugated to the linker through the 5' end of the nucleotide or nucleotide analog. In some embodiments, the present disclosure provides said composition wherein one of the nucleotides or nucleotide analogs comprises deoxyadenosine, deoxyguanosine, thymidine, deoxyuridine, deoxycytidine, adenosine, guanosine, 5-methyl-uridine, and/or cytidine; and wherein the length of the linker is between 1 and 1,000 nm. In some embodiments, the present disclosure provides said composition wherein at least one nucleotide or nucleotide analog is a nucleotide that has been modified to inhibit elongation during a polymerase reaction or a sequencing reaction, such as wherein the at least one nucleotide or nucleotide analog is a nucleotide that lacks a 3' hydroxyl group; a nucleotide that has been modified to contain a blocking group at the 3' position; and/or a nucleotide that has been modified with a 3'-O-azido group, a 3'-O-azidomethyl group, a 3'-O-alkyl hydroxylamino group, a 3'-phosphorothioate group, a 3'-O-malonyl group, or a 3'-O-benzyl group. In some embodiments, the present disclosure provides said composition wherein at least one nucleotide or nucleotide analog is a nucleotide that has not been modified at the 3' position.

In some embodiments, blocking groups may be attached to one or more nucleotides. For example, occluding, removing, or protecting the sugar 3' OH position prevents inadvertent extension of DNA primer templates beyond a single base pair to ensure no loss of information. Successful 3' blocking group criteria have been outlined generally as: 1) The polymerase enzyme should accurately and efficiently incorporate the dNTPs carrying the 3' blocking groups into the elongating nucleic acid chain; 2) Mild conditions for rapid and complete deblocking should be available; and 3) The polymerase should be able to reinitiate or resume synthesis upon deblocking of 3' group.

In some embodiments, 3' blocking groups comprise those that can be incorporated in a template dependent fashion and quickly deblocked to yield an extendable 3'—OH group. Representative blocking groups include, for example, esters and ethers. Other representative 3' blocking groups include but are not limited to, —F, $—NH_2$, $—OCH_3$, $—N_3$, $—PO_3$, $—NHCOCH_3$, 2-nitrobenzene carbonate, 2,4-dinitrobenzen sulfenyl and tetrahydrofuranyl ether. In some embodiments, a property of useful blocking groups includes incorporation and chain termination, which have been demonstrated with a plurality of the exemplary blocking groups disclosed herein. Additional exemplary blocking groups may comprise lower (1-4 carbon) alkanoic acid and substituted lower alkanoic acid esters, such as, for example, formyl, aceytyl, isopropanoyl, alpha fluoro and alpha chlroacetyl esters, and the like; Ether blocking groups such as alkyl ethers, phosphate blocking groups; carbonate blocking groups, such as 2-nitrobenzyl; 2-4dinitrobenzene-suflenyl, and teterahydrothiofuranyl ether blocking groups). Additional exemplary blocking groups include but are not limited to MOM ($CH_2OCH_3$) and allyl ($CH_2—CH=CH_2$), which may be cleaved with high yields.

The present disclosure also contemplates a method of labeling a nucleic acid molecule, where the method comprises incorporating into the nucleic acid molecule a nucleotide or nucleoside molecule, where the nucleotide or nucleoside molecule has a base that is linked to a detectable label via a cleavable linker. In some embodiments, the incorporating step may be accomplished via a terminal transferase, a polymerase or a reverse transcriptase. In some embodiments, the base can be a purine, or a pyrimidine. In some embodiments, the base can be a deazapurine. In some embodiments, the nucleotide or nucleoside molecule can have a ribose or deoxyribose sugar moiety. In some embodiments, the ribose or deoxyribose sugar can include a protecting group attached via the 2' or 3' oxygen atom. In some embodiments, the protecting group can be removed to expose a 3'—OH group. In some embodiments, the molecule can be a deoxyribonucleotide triphosphate. In some embodiments, the detectable label can be a fluorophore, a chromophore, an electrochemical label, or a spin label. In some embodiments, the linker can be an acid labile linker, a photolabile linker, or can contain a disulfide linkage. In some embodiments, the detectable label and/or the cleavable linker can be of a size or chemical nature sufficient to prevent the incorporation of a second nucleotide or nucleoside into the nucleic acid molecule.

The present disclosure provides methods for forming a plurality of complexed polymerases, comprising step (a): contacting a plurality of mutant polymerases with (i) a plurality of nucleic acid template molecules and (ii) a plurality of nucleic acid primers, under a condition suitable to bind the plurality of mutant polymerases to the plurality of nucleic acid template molecules and the plurality of nucleic acid primers, thereby forming a plurality of complexed polymerases each comprising a mutant polymerase bound to a nucleic acid duplex wherein the nucleic acid duplex comprises a nucleic acid template molecule hybridized to a nucleic acid primer. In some embodiments, the plurality of mutant polymerases comprise a DNA polymerase. In some embodiments, the plurality of mutant polymerases comprise a plurality of recombinant mutant polymerases as described herein. In some embodiments, the mutant polymerases include one or more example mutant polymerase features discussed above. In some embodiments, the mutant DNA polymerases exhibit increased thermal stability at a temperature range of about 25-50° C. or about 45-75° C. compared to the wild type polymerase comprising SEQ ID NO: 1.

In some embodiments, in the methods for forming a plurality of complexed polymerases, the primer comprises a 3' extendible end or a 3' non-extendible end. In some embodiments, the plurality of nucleic acid template molecules may include the nucleic acid template embodiments, including any of the potential features listed above.

In some embodiments, in the methods for forming a plurality of complexed polymerases, the plurality of nucleic acid template molecules and/or the plurality of nucleic acid primers are in solution or are immobilized to a support. In some embodiments, when the plurality of nucleic acid template molecules and/or the plurality of nucleic acid primers are immobilized to a support, the binding with the recombinant mutant polymerase generates a plurality of immobilized complexed polymerases. In some embodiments, the plurality of nucleic acid template molecules and/or nucleic acid primers are immobilized to $10^2$-$10^{15}$ different sites on a support. In some embodiments, the binding of the plurality of template molecules and nucleic acid primers with the plurality of recombinant mutant polymerases generates a plurality of complexed polymerases immobilized to $10^2$-$10^{15}$ different sites on the support. In some embodiments, the plurality of immobilized complexed polymerases on the support are immobilized to pre-determined or to random sites on the support. In some embodiments, the plurality of immobilized complexed polymerases are in fluid communication with each other to permit flowing a solution of reagents (e.g., enzymes including polymerases, multivalent molecules, nucleotides, and/or divalent cations) onto the support so that the plurality of immobilized complexed polymerases on the support are reacted with the solution of reagents in a massively parallel manner.

In some embodiments, the methods for forming a plurality of complexed polymerases generally comprise: (a) contacting a plurality of mutant polymerases with (i) a plurality of nucleic acid template molecules and (ii) a plurality of nucleic acid primers to form a plurality of complexed polymerases; (b1) contacting the plurality of complexed polymerases with a plurality of multivalent molecules to form a plurality of multivalent-complexed polymerases. In some embodiments, the method further comprises step (c1): detecting the multivalent molecules that are bound to the complexed polymerases. In some embodiments, the method further comprises step (d1): identifying the complementary nucleotide unit of the multivalent molecules that are bound to the complexed polymerases.

In some embodiments, the methods for forming a plurality of complexed polymerases further comprise step (b1): contacting the plurality of complexed polymerases with a plurality of multivalent molecules, wherein individual multivalent molecules in the plurality comprise a core attached to multiple nucleotide arms and each nucleotide arm is attached to a nucleotide (e.g., a nucleotide unit). In some embodiments, the binding of the complementary nucleotide unit of the multivalent molecules to the complexed polymerases forms a plurality of multivalent-complexed polymerases. In some embodiments, the contacting in step (b1) is conducted under a condition suitable for binding a complementary nucleotide unit of at least one of the multivalent molecules to at least one of the complexed polymerases. In some embodiments, the condition is suitable for inhibiting incorporation of the complementary nucleotide units into the primers of the plurality of multivalent-complexed polymerases. In some embodiments, the contacting in step (b1) is conducted under a condition suitable for binding a nucleotide of at least one of the multivalent molecules to at least one of the complexed polymerases but the bound nucleotide does not incorporate into the 3' end of the nucleic acid primer.

In some embodiments, in the methods for forming a plurality of complexed polymerases, individual multivalent molecules in the plurality of multivalent molecules may include any of the multivalent molecule embodiments, including any of the potential features listed above.

In some embodiments, in the methods for forming a plurality of complexed polymerases, the binding of the plurality of complexed polymerases with the plurality of multivalent molecules forms at least one avidity complex, the method comprising the steps: (a) binding a first nucleic acid primer, a first DNA polymerase, and a first multivalent molecule to a first portion of a concatemer template molecule thereby forming a first binding complex, wherein a first nucleotide unit of the first multivalent molecule binds to the first DNA polymerase; and (b) binding a second nucleic acid primer, a second DNA polymerase, and the first multivalent molecule to a second portion of the same concatemer template molecule thereby forming a second binding complex, wherein a second nucleotide unit of the first multivalent molecule binds to the second DNA polymerase, wherein the first and second binding complexes which include the same multivalent molecule forms an avidity complex. In some embodiments, the first polymerase comprises any wild type or mutant polymerase described herein. In some embodiments, the second polymerase comprises any wild type or mutant polymerase described herein. The concatemer template molecule comprises tandem repeat sequences of a sequence of interest and at least one universal sequencing primer binding site. The first and second nucleic acid primers can bind to a sequencing primer binding site along the concatemer template molecule.

In some embodiments, in the methods for forming a plurality of complexed polymerases, the binding of the plurality of complexed polymerases with the plurality of multivalent molecules forms at least one avidity complex, the method comprising the steps: (a) binding a first nucleic acid primer, a first DNA polymerase, and a first multivalent molecule to a first template molecule thereby forming a first binding complex, wherein a first nucleotide unit of the first multivalent molecule binds to the first DNA polymerase; and (b) binding a second nucleic acid primer, a second DNA polymerase, and the first multivalent molecule to a second template molecule thereby forming a second binding complex, wherein a second nucleotide unit of the first multivalent molecule binds to the second DNA polymerase, wherein the first and second binding complexes which include the same multivalent molecule forms an avidity complex. In some embodiments, the first polymerase comprises any wild type or mutant polymerase described herein. In some embodiments, the second polymerase comprises any wild type or mutant polymerase described herein. In some embodiments, the first and second template molecules are clonally amplified template molecules. In some embodiments, the first and second template molecules are localized in close proximity to each other. For example, the clonally-amplified first and second template molecules comprise linear template molecules that are generated via bridge amplification and are immobilized to the same location or feature on a support. The first and second template molecules comprise a sequence of interest and at least one universal sequencing primer binding site. The first and second nucleic acid primers can bind to a sequencing primer binding site on the first and second template molecules, respectively.

In some embodiments, in the methods for forming a plurality of complexed polymerases, at least one of the multivalent molecules in the plurality of multivalent molecules is labeled with a detectable reporter moiety. In some embodiments, the detectable reporter moiety comprises a fluorophore. In some embodiments, the core of the multivalent molecule is labeled with a fluorophore, and wherein the fluorophore which is attached to a given core of the multivalent molecule corresponds to the nucleotide base (e.g., adenine, guanine, cytosine, thymine or uracil) of the nucleotide arm. In some embodiments, at least one of the nucleotide arms of the multivalent molecule comprises a linker and/or nucleotide base that is attached to a fluorophore, and wherein the fluorophore which is attached to a given linker or nucleotide base corresponds to the nucleotide base (e.g., adenine, guanine, cytosine, thymine or uracil) of the nucleotide arm.

In some embodiments, in the methods for forming a plurality of complexed polymerases, the plurality of multivalent molecules comprise at least one multivalent molecule having multiple nucleotide arms each attached with a nucleotide analog (e.g., nucleotide analog unit), where the nucleotide analog includes a chain terminating moiety at the sugar 2' and/or 3' position. In some embodiments, the plurality of multivalent molecules comprises at least one multivalent molecule comprising multiple nucleotide arms each attached with a nucleotide unit that lacks a chain terminating moiety.

In some embodiments, in the methods for forming a plurality of complexed polymerases, the contacting of step (b1) is conducted in the presence of at least one cation selected from a group consisting of strontium, barium, sodium, magnesium, potassium, manganese, calcium, lithium, nickel and cobalt. In some embodiments, the contacting of step (b1) is conducted in the presence of strontium, barium and/or calcium.

In some embodiments, in the methods for forming a plurality of complexed polymerases, the contacting of step (a) is conducted at a constant temperature which is selected from a temperature range of about 25-51° C. In some embodiments, the contacting of step (b1) is conducted at a constant temperature which is selected from a temperature range of about 25-51° C. In some embodiments, the contacting of steps (a) and (b1) are conducted at a constant temperature which is selected from a temperature range of about 25-51° C. (e.g., isothermal temperature).

In some embodiments, the methods for forming a plurality of complexed polymerases further comprise step (c1): detecting the multivalent molecule which is bound to the complexed polymerase. In some embodiments, the detecting includes detecting the multivalent molecules that are bound to the complexed polymerases, where the complementary nucleotide units of the multivalent molecules are bound to the primers but incorporation of the complementary nucleotide units is inhibited. In some embodiments, the multivalent molecules are labeled with a detectable reporter moiety to permit detection. In some embodiments, the labeled multivalent molecules comprise a fluorophore attached to the core, the linker and/or the base of the nucleotide unit of the multivalent molecules.

In some embodiments, the methods for forming a plurality of complexed polymerases further comprise step (d1): identifying the complementary nucleotide unit of the multivalent molecule which is bound to the complexed polymerase. In some embodiments, the identifying the complementary nucleotide unit of the multivalent molecule can be used to determine the sequence of the nucleic acid template. In some embodiments, the multivalent molecules are labeled with a detectable reporter moiety that corresponds to the particular nucleotide units attached to the nucleotide arms to permit identification of the complementary nucleotide units (e.g., nucleotide base adenine, guanine, cytosine, thymine or uracil) that are bound to the plurality of complexed polymerases. In some embodiments the detecting of step (c1) and the identifying of step (d1) can be used to determine the sequence of the nucleic acid template molecules.

In some embodiments, the methods for forming a plurality of complexed polymerases generally comprise: (a) contacting a plurality of mutant polymerases with (i) a plurality of nucleic acid template molecules and (ii) a plurality of nucleic acid primers to form a plurality of complexed polymerases; (b2) contacting the plurality of complexed polymerases with a plurality of nucleotides to form a plurality of nucleotide-complexed polymerases. In some embodiments, the method further comprises step (c2): detecting the complementary nucleotides which are incorporated into the primers of the nucleotide-complexed polymerases. In some embodiments, the method further comprises step (d2): identifying the bases of the complementary nucleotides which are incorporated into the primers of the nucleotide-complexed polymerases.

In some embodiments, the methods for forming a plurality of complexed polymerases further comprise step (b2): contacting the plurality of complexed polymerases of step (a) with a plurality of nucleotides under a condition suitable for binding a complementary nucleotide from the plurality of nucleotides to a complexed polymerase from the plurality of complexed polymerases thereby forming a nucleotide-complexed polymerase. In some embodiments, the contacting of step (b2) is conducted under a condition that is suitable for promoting incorporation of the bound complementary nucleotides into the primers of the nucleotide-complexed polymerases thereby forming a plurality of nucleotide-complexed polymerases. In some embodiments, the incorporating the nucleotide into the 3' end of the primer in step (b2) comprises a primer extension reaction. In some embodiments, the contacting of step (b2) is conducted in the presence of at least one cation selected from a group consisting of strontium, barium, sodium, magnesium, potassium, manganese, calcium, lithium, nickel and cobalt. In some embodiments, the contacting of step (b2) is conducted in the presence of magnesium and/or manganese. In some embodiments, individual nucleotides in the plurality comprise a nucleotide unit that includes one or more example nucleotide unit features as discussed above. In some embodiments, the plurality of nucleotides comprise native nucleotides (e.g., non-analog nucleotides) or nucleotide analogs. In some embodiments, individual nucleotides in the plurality of nucleotides comprise a chain terminating moiety attached to the 2' and/or 3' sugar position. In some embodiments, the plurality of nucleotides comprise a 2' and/or 3' chain terminating moiety which is removable or is not removable. In some embodiments, the chain terminating moiety comprises an azide, azido or azidomethyl group, including any of the potential features listed above. In some embodiments, the azide, azido or azidomethyl group is removable from the nucleotide with a phosphine compound. One skilled in the art will recognize that other removable chain terminating moieties are possible. In some embodiments, the plurality of nucleotides comprises a plurality of nucleotides labeled with detectable reporter moiety. The detectable reporter moiety comprises a fluorophore. In some embodiments, the fluorophore is attached to the nucleotide base. In some embodiments, the fluorophore is attached to the nucleotide base with a linker which is cleavable/removable from the base or is not removable from the base. In some embodiments, at least one of the nucleotides in the plurality is not labeled with a detectable reporter moiety. In some embodiments, a particular detectable reporter moiety (e.g., fluorophore) that is attached to the nucleotide can correspond to the nucleotide base (e.g., dATP, dGTP, dCTP, dTTP or dUTP) to permit detection and identification of the nucleotide base.

In some embodiments, in the methods for forming a plurality of complexed polymerases, the contacting of step (a) is conducted at a constant temperature which is selected from a temperature range of about 25-51° C. In some embodiments, the contacting of step (b2) is conducted at a constant temperature which is selected from a temperature range of about 25-51° C. In some embodiments, the contacting of steps (a) and (b2) are conducted at a constant temperature which is selected from a temperature range of about 25-51° C. (e.g., isothermal temperature).

In some embodiments, the methods for forming a plurality of complexed polymerases further comprise step (c2): detecting the complementary nucleotides which are incorporated into the primers of the nucleotide-complexed polymerases. In some embodiments, the plurality of nucleotides are labeled with a detectable reporter moiety to permit detection.

In some embodiments, the methods for forming a plurality of complexed polymerases further comprises the step (d2): identifying the bases of the complementary nucleotides which are incorporated into the 3' end of the primers of the nucleotide-complexed polymerases. In some embodiments the detecting of step (c2) and the identifying of step (d2) can be used to determine the sequence of the nucleic acid template molecules.

Alternatively, the methods for forming a plurality of complexed polymerases further comprise step (b2): contacting the plurality of complexed polymerases of step (a) with a plurality of nucleotides under a condition suitable for binding a complementary nucleotide from the plurality of nucleotides to a complexed polymerase from the plurality of complexed polymerases thereby forming a nucleotide-complexed polymerase. In some embodiments, the contacting of step (b2) is conducted under a condition that is suitable for promoting nucleotide binding but inhibiting incorporation of the bound complementary nucleotides to the 3' end of the primers of the nucleotide-complexed polymerases. In some embodiments, the contacting of step (b2) is conducted in the presence of at least one cation selected from a group consisting of strontium, barium, sodium, magnesium, potassium, manganese, calcium, lithium, nickel and cobalt. The plurality of complexed polymerases can be contacted sequentially with at least two separate mixtures where each mixture comprises an engineered polymerase and a nucleotide. The contacting is conducted under conditions suitable for forming stable ternary complexes with cognates for first, second and third base type base types in the template. The method further comprises step (c3) examining the at least two separate mixtures to determine if a ternary complex formed. The method further comprises step (d3) identifying the next correct nucleotide for the primed template nucleic acid molecule, wherein the next correct nucleotide is identified as a cognate of the first, second or third base type if ternary complex is detected in step (c3), and wherein the next correct nucleotide is imputed to be a nucleotide cognate of a fourth base type based on the absence of a ternary complex in step (c3). The method further comprises step (e3) adding a next correct nucleotide to the primer of the primed template nucleic acid after step (c3), thereby producing an extended primer; and step (f3) repeating steps (a) through (e3) for the primed template nucleic acid that comprises the extended primer.

In some embodiments, in the methods for forming a plurality of complexed polymerases, at least one multivalent molecule in the plurality of multivalent molecules of step (b1) may embody any of the multivalent molecule embodiments, including any of the potential features listed above.

In some embodiments, in the methods for forming a plurality of complexed polymerases, at least one multivalent molecule in the plurality of multivalent molecules of step (b1) comprise a nucleotide unit having a chain of one, two or three phosphorus atoms where the chain is typically attached to the 5' carbon of the sugar moiety via an ester or phosphoramide linkage. In some embodiments, at least one nucleotide unit is a nucleotide analog having a phosphorus chain in which the phosphorus atoms are linked together with intervening O, S, NH, methylene or ethylene. In some embodiments, the phosphorus atoms in the chain include substituted side groups including O, S or $BH_3$. In some embodiments, the chain includes phosphate groups substituted with analogs including phosphoramidate, phosphorothioate, phosphorodithioate, and O-methylphosphoroamidite groups.

In some embodiments, in the methods for forming a plurality of complexed polymerases, individual multivalent molecules in the plurality of multivalent molecule of step (b1) comprise a core attached to multiple nucleotide arms, and wherein individual nucleotide arms comprise a nucleotide unit having a chain terminating moiety (e.g., blocking moiety) at the sugar 2' position, at the sugar 3' position, or at the sugar 2' and 3' position.

In some embodiments, in the methods for forming a plurality of complexed polymerases, at least one multivalent molecule in the plurality of multivalent molecules of step (b1) comprises a nucleotide unit comprising a terminator nucleotide analog that includes one or more example nucleotide analog features discussed above.

In some embodiments, in the methods for forming a plurality of complexed polymerases, at least one multivalent molecule in the plurality of multivalent molecules of step (b1) comprises a nucleotide unit comprising a terminator nucleotide analog having a chain terminating moiety (e.g., blocking moiety) at the sugar 2' position, at the sugar 3' position, or at the sugar 2' and 3' position. The chain terminating moiety can be attached to the 3'—OH sugar position via a cleavable moiety, which may include any of the chain terminating moiety embodiments described above. In some embodiments the chain terminating moiety comprises an azide, azido, or azidomethyl group, including any of the potential features listed above.

In some embodiments, in the methods for forming a plurality of complexed polymerases, at least one multivalent molecule in the plurality of multivalent molecules of step (b1) comprises a core attached to multiple nucleotide arms, wherein the core is labeled with detectable reporter moiety. In some embodiments, the detectable reporter moiety comprises a fluorophore. In some embodiments, a particular detectable reporter moiety (e.g., fluorophore) that is attached to the multivalent molecule can correspond to the base (e.g., dATP, dGTP, dCTP, dTTP or dUTP) of the nucleotide unit to permit detection and identification of the nucleotide base. In some embodiments, at least one of the nucleotide arms of the multivalent molecule comprises a linker and/or nucleotide base that is attached to a fluorophore, and wherein the fluorophore which is attached to a given linker or nucleotide base corresponds to the nucleotide base (e.g., adenine, guanine, cytosine, thymine or uracil) of the nucleotide arm. In some embodiments, at least one multivalent molecule lacks a fluorophore.

In some embodiments, in the methods for forming a plurality of complexed polymerases, at least one nucleotide arm of a multivalent molecule in the plurality of multivalent molecules of step (b1) has a nucleotide unit that is attached to a detectable reporter moiety. In some embodiments, the detectable reporter moiety is attached to the nucleotide base. In some embodiments, the detectable reporter moiety comprises a fluorophore. In some embodiments, a particular detectable reporter moiety (e.g., fluorophore) that is attached to the multivalent molecule can correspond to the base (e.g., dATP, dGTP, dCTP, dTTP or dUTP) of the nucleotide unit to permit detection and identification of the nucleotide base.

In some embodiments, in the methods for forming a plurality of complexed polymerases, the core of a multivalent molecule of step (b1) comprises an avidin-like moiety and the core attachment moiety comprises biotin. In some embodiments, the core comprises an streptavidin-type or avidin-type moiety which includes an avidin protein, as well as any derivatives, analogs and other non-native forms of avidin that can bind to at least one biotin moiety. Other forms of avidin moieties include native and recombinant avidin and streptavidin as well as derivatized molecules, e.g. non-glycosylated avidin and truncated streptavidins. For example, avidin moiety includes de-glycosylated forms of avidin, bacterial streptavidin produced by *Streptomyces* (e.g., *Streptomyces avidinii*), as well as derivatized forms, for example, N-acyl avidins, e.g., N-acetyl, N-phthalyl and N-succinyl avidin, and the commercially-available products ExtrAvidin™, Captavidin™, Neutravidin™, and Neutralite Avidin™.

In some embodiments, in the methods for forming a plurality of complexed polymerases, at least one nucleotide in the plurality of nucleotides of step (b2) comprise a base, sugar and at least one phosphate group. In some embodiments, at least one nucleotide in the plurality comprises a nucleotide unit that includes one or more example nucleotide unit features as discussed above. In some embodiments, at least one nucleotide in the plurality is not a nucleotide analog. In some embodiments, at least one nucleotide in the plurality comprises a nucleotide analog.

In some embodiments, in the methods for forming a plurality of complexed polymerases, at least one nucleotide in the plurality of nucleotides of step (b2) comprise a chain of one, two or three phosphorus atoms where the chain is typically attached to the 5' carbon of the sugar moiety via an ester or phosphoramide linkage. In some embodiments, at least one nucleotide in the plurality is an analog having a phosphorus chain in which the phosphorus atoms are linked together with intervening O, S, NH, methylene or ethylene. In some embodiments, the phosphorus atoms in the chain include substituted side groups including O, S or $BH_3$. In some embodiments, the chain includes phosphate groups substituted with analogs including phosphoramidate, phosphorothioate, phosphorodithioate, and O-methylphosphoroamidite groups.

In some embodiments, in the methods for forming a plurality of complexed polymerases, at least one nucleotide in the plurality of nucleotides of step (b2). The nucleotide may take the form of a terminator nucleotide analog that includes one or more example nucleotide analog features discussed above.

In some embodiments, in the methods for forming a plurality of complexed polymerases, at least one nucleotide in the plurality of nucleotides of step (b2) comprises a terminator nucleotide analog having a chain terminating moiety (e.g., blocking moiety) at the sugar 2' position, at the sugar 3' position, or at the sugar 2' and 3' position, which may include any of the chain terminating moiety embodiments described above. In some embodiments the chain terminating moiety comprises an azide, azido, or azidomethyl group, including any of the potential features listed above.

In some embodiments, in the methods for forming a plurality of complexed polymerases, at least one nucleotide in the plurality of nucleotides of step (b2) comprises a detectable reporter moiety. In some embodiments, at least one nucleotide in the plurality of nucleotides of step (b2) comprises a labeled nucleotide. In some embodiments, the detectable reporter moiety comprises a fluorophore. In some embodiments, the fluorophore is attached to the nucleotide base. In some embodiments, the fluorophore is attached to the nucleotide base with a linker which is cleavable/removable from the base. In some embodiments, at least one of the nucleotides in the plurality is not labeled with a detectable reporter moiety. In some embodiments, a particular detectable reporter moiety (e.g., fluorophore) that is attached to the nucleotide can correspond to the nucleotide base (e.g., dATP, dGTP, dCTP, dTTP or dUTP) to permit detection and identification of the nucleotide base.

In some embodiments, in the methods for forming a plurality of complexed polymerases, at least one nucleotide in the plurality of nucleotides of step (b2) comprises a terminal nucleotide analog that includes one or more example nucleotide analog features discussed above.

In some embodiments, in the methods for forming a plurality of complexed polymerases, at least one nucleotide in the plurality of nucleotides of step (b2) comprises a cleavable linker on the base which comprises a cleavable moiety including an azide, azido or azidomethyl group. In some embodiments, the cleavable moieties azide, azido and azidomethyl group are cleavable/removable with a phosphine compound. In some embodiments, the phosphine compound comprises a derivatized tri-alkyl phosphine moiety or a derivatized tri-aryl phosphine moiety. In some embodiments, the phosphine compound comprises Tris(2-carboxyethyl)phosphine (TCEP) or bis-sulfo triphenyl phosphine (BS-TPP) or Tri(hydroxyproyl)phosphine (THPP). In some embodiments, the cleaving agent comprises 4-dimethylaminopyridine (4-DMAP).

In some embodiments, in the methods for forming a plurality of complexed polymerases, at least one nucleotide in the plurality of nucleotides of step (b2) comprises a chain terminating moiety at the sugar 2' and/or the sugar 3' position, and a cleavable linker on the base, wherein the chain terminating moiety on the sugar and the cleavable linker on the base have the same or different cleavable moieties. In some embodiments, the chain terminating moiety (e.g., at the sugar 2' and/or sugar 3' position) and the detectable reporter moiety linked to the base are chemically cleavable/removable with the same chemical agent. In some embodiments, the chain terminating moiety (e.g., at the sugar 2' and/or sugar 3' position) and the detectable reporter moiety linked to the base are chemically cleavable/removable with different chemical agents.

In some embodiments, in the methods for forming a plurality of complexed polymerases, the support of step (a) comprises a planar or non-planar support. The support can be solid or semi-solid. In some embodiments, the support can be porous, semi-porous or non-porous. In some embodiments, the surface of the support can be coated with one or more compounds to produce a passivated layer on the support. In some embodiments, the passivated layer forms a porous or semi-porous layer. In some embodiments, the nucleic acid primer, template and/or polymerase, can be attached to the passivated layer to immobilize the primer, template and/or polymerase to the support. In some embodiments, the support comprises a low non-specific binding surface that enable improved nucleic acid hybridization and amplification performance on the support. In general, the support may comprise one or more layers of a covalently or non-covalently attached low-binding, chemical modification layers, e.g., silane layers, polymer films, and one or more covalently or non-covalently attached oligonucleotides that can be used for immobilizing a plurality of nucleic acid template molecules to the support. In some embodiments, the support can comprise a functionalized polymer coating layer covalently bound at least to a portion of the support via a chemical group on the support, a primer grafted to the functionalized polymer coating, and a water-soluble protective coating on the primer and the functionalized polymer coating. In some embodiments, the functionalized polymer coating comprises a poly(N-(5-azidoacetamidylpentyl)acrylamide-co-acrylamide (PAZAM). In some embodiments, the support comprises a surface coating having at least one hydrophilic polymer coating layer and at least one layer of a plurality of oligonucleotides. The hydrophilic polymer coating layer can comprise polyethylene glycol (PEG). The hydrophilic polymer coating layer can comprise branched PEG having at least 4 branches. In some embodiments, the support comprises a low non-specific binding coating having a water contact angle of no more than 45 degrees. In some embodiments, the density of the plurality of complexed polymerases immobilized to the support or immobilized to the coating on the support is about $10^2$-$10^6$ per $mm^2$, or about $10^6$-$10^9$ per $mm^2$, or about $10^9$-$10^{12}$ per $mm^2$, or about $10^{12}$-$10^{15}$ per $mm^2$ In some embodiments, the plurality of complexed polymerases is immobilized to the support or immobilized to the coating on the support at pre-determined sites on the support (or the coating on the support), or immobilized to the coating on the support at random sites on the support (or the coating on the support). The present disclosure provides methods for binding a mutant polymerase to a nucleotide, comprising: (a) contacting a mutant polymerase to (i) a nucleic acid template molecule and (ii) a nucleic acid primer, wherein the contacting is conducted under a condition suitable to bind the mutant polymerase to the nucleic acid template molecule which is hybridized to the nucleic acid primer, wherein the nucleic acid template molecule hybridized to the nucleic acid primer forms the nucleic acid duplex. In some embodiments, the mutant polymerase comprises a recombinant mutant polymerase. In some embodiments, the primer comprises a 3' extendible end or a 3' non-extendible end. In some embodiments, the mutant polymerase includes one or more features listed above in connection to example mutant polymerase features.

In some embodiments, the methods for binding a mutant polymerase to a nucleotide further comprise (b) contacting the mutant polymerase with a plurality of nucleotides under a condition suitable for binding at least one nucleotide to the mutant polymerase which is bound to the nucleic acid duplex. In some embodiments, the mutant polymerase is contacted with the plurality of nucleotides in the presence of at least one cation selected from a group consisting of strontium, barium, sodium, magnesium, potassium, manganese, calcium, lithium, nickel and cobalt. In some embodiments, the contacting of step (b) is conducted in the presence of strontium, barium and/or calcium. In some embodiments, the at least one nucleotide binds the mutant polymerase does not incorporate into the 3' end of the extendible or non-extendible primer. In some embodiments, the plurality of nucleotides comprises at least one nucleotide analog having a chain terminating moiety at the sugar 2' or 3' position. In some embodiments, the plurality of nucleotides comprises at least one nucleotide that lacks a chain terminating moiety. In some embodiments, the method further comprises (c) detecting the at least one nucleotide that is bound to the polymerase but has not incorporated into the 3' end of the primer. In some embodiments, the method further comprises (d) identifying the at least one nucleotide that is bound to the polymerase but has not incorporated into the 3' end of the primer.

The present disclosure provides methods for incorporating a nucleotide, sequence of a nucleic acid template molecule, or binding a mutant polymerase, comprising: (a) contacting a mutant polymerase to (i) a nucleic acid template molecule and (ii) a nucleic acid primer, wherein the contacting is conducted under a condition suitable to bind the mutant polymerase to the nucleic acid template molecule which is hybridized to the nucleic acid primer, wherein the nucleic acid template molecule hybridized to the nucleic acid primer forms the nucleic acid duplex. In some embodiments, the mutant polymerase comprises a recombinant mutant polymerase including the features described herein. In some embodiments, the mutant polymerases include one or more example mutant polymerase features discussed above. In some embodiments, the primer comprises a 3' extendible end.

In some embodiments, the methods for incorporating a nucleotide further comprise (b) contacting the mutant polymerase with a plurality of nucleotides under a condition suitable for binding at least one nucleotide to the mutant polymerase which is bound to the nucleic acid duplex. In some embodiments, the mutant polymerase is contacted with the plurality of nucleotides in the presence of at least one cation selected from a group consisting of strontium, barium, sodium, magnesium, potassium, manganese, calcium, lithium, nickel and cobalt. In some embodiments, the contacting of step (b) is conducted in the presence of strontium, barium and/or calcium. In some embodiments, the plurality of nucleotides comprises at least one nucleotide analog having a chain terminating moiety at the sugar 2' or 3' position. In some embodiments, the plurality of nucleotides comprises at least one nucleotide that lacks a chain terminating moiety. In some embodiments, the method further comprises (c) incorporating at least one nucleotide into the 3' end of the extendible primer under a condition suitable for incorporating the at least one nucleotide. In some embodiments, the suitable conditions for nucleotide binding the mutant polymerase and for incorporation the nucleotide can be the same or different. In some embodiments, conditions suitable for incorporating the nucleotide comprise inclusion of at least one cation selected from a group consisting of strontium, barium, sodium, magnesium, potassium, manganese, calcium, lithium, nickel and cobalt. In some embodiments, the at least one nucleotide binds the mutant polymerase and incorporates into the 3' end of the extendible primer. In some embodiments, the incorporating the nucleotide into the 3' end of the primer in step (c) comprises a primer extension reaction. In some embodiments, the method further comprises (d) repeating the incorporating at least one nucleotide into the 3' end of the extendible primer of step (c) at least once. In some embodiments, the method further comprises detecting the at least one incorporated nucleotide at step (c) and/or (d). In some embodiments, the method further comprises identifying the at least one incorporated nucleotide at step (c) and/or (d). In some embodiments, the sequence of the nucleic acid template molecule can be determined by detecting and identifying the nucleotide that binds the mutant polymerase. In some embodiments, the sequence of the nucleic acid template molecule can be determined by detecting and identifying the nucleotide that incorporates into the 3' end of the primer.

The present disclosure provides methods for determining the sequence of a nucleic acid template molecule, comprising: (a) contacting a mutant polymerase to (i) a nucleic acid template molecule and (ii) a nucleic acid primer, wherein the contacting is conducted under a condition suitable to bind the mutant polymerase to the nucleic acid template molecule which is hybridized to the nucleic acid primer, wherein the nucleic acid template molecule hybridized to the nucleic acid primer forms the nucleic acid duplex. In some embodiments, the mutant polymerase comprises a recombinant mutant polymerase. In some embodiments, the mutant polymerase includes one or more features listed above in connection to example mutant polymerase features.

In some embodiments, the methods for determining the sequence of a nucleic acid template molecule further comprise contacting the (b) contacting the mutant polymerase with a plurality of nucleotides under a condition suitable for binding at least one nucleotide to the mutant polymerase which is bound to the nucleic acid duplex. In some embodiments, the mutant polymerase is contacted with the plurality of nucleotides in the presence of at least one cation selected from a group consisting of strontium, barium, sodium, magnesium, potassium, manganese, calcium, lithium, nickel and cobalt. In some embodiments, the contacting of step (b) is conducted in the presence of strontium, barium and/or calcium. In some embodiments, the plurality of nucleotides comprises at least one nucleotide analog having a chain terminating moiety at the sugar 2' or 3' position. In some embodiments, the plurality of nucleotides comprises at least one nucleotide that lacks a chain terminating moiety. In some embodiments, the method further comprises (c) incorporating at least one nucleotide into the 3' end of the extendible primer under a condition suitable for incorporating the at least one nucleotide. In some embodiments, the suitable conditions for nucleotide binding the mutant polymerase and for incorporation the nucleotide can be the same or different. In some embodiments, conditions suitable for incorporating the nucleotide comprise inclusion of at least one cation selected from a group consisting of strontium, barium, sodium, magnesium, potassium, manganese, calcium, lithium, nickel and cobalt. In some embodiments, the at least one nucleotide binds the mutant polymerase and incorporates into the 3' end of the extendible primer. In some embodiments, the incorporating the nucleotide into the 3' end of the primer in step (c) comprises a primer extension reaction. In some embodiments, the method further comprises (d) repeating the incorporating at least one nucleotide into the 3' end of the extendible primer of step (c) at least once. In some embodiments, the plurality of nucleotides comprises a plurality of nucleotides labeled with detectable reporter moiety. The detectable reporter moiety may, or may not, comprise a fluorophore. In some embodiments, the fluorophore is attached to the nucleotide base. In some embodiments, the fluorophore is attached to the nucleotide base with a linker which is cleavable/removable from the base. In some embodiments, at least one of the nucleotides in the plurality is not labeled with a detectable reporter moiety. In some embodiments, a particular detectable reporter moiety (e.g., fluorophore) that is attached to the nucleotide can correspond to the nucleotide base (e.g., dATP, dGTP, dCTP, dTTP or dUTP) to permit detection and identification of the nucleotide base. In some embodiments, the method further comprises detecting the at least one incorporated nucleotide at step (c) and/or (d). In some embodiments, the method further comprises identifying the at least one incorporated nucleotide at step (c) and/or (d). In some embodiments, the sequence of the nucleic acid template molecule can be determined by detecting and identifying the nucleotide that binds the mutant polymerase, thereby determining the sequence of the nucleic acid template. In some embodiments, the sequence of the nucleic acid template molecule can be determined by detecting and identifying the nucleotide that incorporates into the 3' end of the primer, thereby determining the sequence of the nucleic acid template.

In some embodiments, in the methods for determining the sequence of a nucleic acid template, the plurality of polymerases that are bound to the nucleic acid duplexes comprise a plurality of complexed polymerases, having at least a first and second complexed polymerase, wherein (a) the first complexed polymerases comprises a first polymerase bound to a first nucleic acid duplex comprising a first nucleic acid template which is hybridized to a first nucleic acid primer, (b) the second complexed polymerases comprises a second polymerase bound to a second nucleic acid duplex comprising a second nucleic acid template which is hybridized to a second nucleic acid primer, (c) the first and second nucleic acid templates comprise different sequences, (d) the first and second nucleic acid templates are clonally-amplified, (e) the first and second primers comprise extendible 3' ends or non-extendible 3' ends, and (f) the plurality of complexed polymerases are immobilized to a support. In some embodiments, the density of the plurality of complexed polymerases is about $10^2$-$10^{15}$ complexed polymerases per $mm^2$ that are immobilized to the support.

In some embodiments, in the method for binding a nucleotide and in the method for incorporating a nucleotide and in the method for sequencing the nucleic acid template using nucleotides, at least one nucleotide in the plurality of nucleotides comprise a base, sugar and at least one phosphate group. In some embodiments, at least one nucleotide in the plurality comprises a nucleotide unit that includes one or more example nucleotide unit features as discussed above. In some embodiments, at least one nucleotide in the plurality is not a nucleotide analog. In some embodiments, at least one nucleotide in the plurality comprises a nucleotide analog.

In some embodiments, in the method for binding a nucleotide and in the method for incorporating a nucleotide and in the method for sequencing the nucleic acid template, at least one nucleotide in the plurality of nucleotides comprise a chain of one, two or three phosphorus atoms where the chain is typically attached to the 5' carbon of the sugar moiety via an ester or phosphoramide linkage. In some embodiments, at least one nucleotide in the plurality is an analog having a phosphorus chain in which the phosphorus atoms are linked together with intervening O, S, NH, methylene or ethylene. In some embodiments, the phosphorus atoms in the chain include substituted side groups including O, S or $BH_3$. In some embodiments, the chain includes phosphate groups substituted with analogs including phosphoramidate, phosphorothioate, phosphorodithioate, and O-methylphosphoroamidite groups.

In some embodiments, in the method for binding a nucleotide and in the method for incorporating a nucleotide and in the method for sequencing the nucleic acid template, at least one nucleotide in the plurality of nucleotides comprises a terminator nucleotide analog that includes one or more example nucleotide analog features discussed above.

In some embodiments, in the method for binding a nucleotide and in the method for incorporating a nucleotide and in the method for sequencing the nucleic acid template, at least one nucleotide in the plurality of nucleotides comprises a terminator nucleotide analog having a chain terminating moiety (e.g., blocking moiety) at the sugar 2' position, at the sugar 3' position, or at the sugar 2' and 3' position. The chain terminating moiety can be attached to the 3'—OH sugar position via a cleavable moiety, which may include any of the chain terminating moiety embodiments described above. In some embodiments the chain terminating moiety comprises an azide, azido, or azidomethyl group, including any of the potential features listed above.

In some embodiments, in the method for binding a nucleotide and in the method for incorporating a nucleotide and in the method for sequencing the nucleic acid template, the plurality of nucleotides comprises a plurality of nucleotides labeled with detectable reporter moiety. The detectable reporter moiety comprises a fluorophore. In some embodiments, the fluorophore is attached to the nucleotide base. In some embodiments, the fluorophore is attached to the nucleotide base with a linker which is cleavable/removable from the base. In some embodiments, at least one of the nucleotides in the plurality is not labeled with a detectable reporter moiety. In some embodiments, a particular detectable reporter moiety (e.g., fluorophore) that is attached to the nucleotide can correspond to the nucleotide base (e.g., dATP, dGTP, dCTP, dTTP or dUTP) to permit detection and identification of the nucleotide base.

In some embodiments, in the method for binding a nucleotide and in the method for incorporating a nucleotide and in the method for sequencing the nucleic acid template, the cleavable linker on the base, the chain terminating moiety can be attached to the 3'—OH sugar position via a cleavable moiety, which may include any of the chain terminating moiety embodiments described above. In some embodiments the chain terminating moiety comprises an azide, azido, or azidomethyl group, including any of the potential features listed above. In some embodiments, in the method for binding a nucleotide and in the method for incorporating a nucleotide and in the method for sequencing the nucleic acid template, the cleavable linker on the base comprises cleavable moiety including an azide, azido or azidomethyl group. The chain terminating moiety can be attached to the 3'—OH sugar position via a cleavable moiety, which may include any of the chain terminating moiety embodiments described above.

In some embodiments, in the method for binding a nucleotide and in the method for incorporating a nucleotide and in the method for sequencing the nucleic acid template, the chain terminating moiety (e.g., at the sugar 2' and/or sugar 3' position), and the cleavable linker on the base have the same or different cleavable moieties. In some embodiments the chain terminating moiety comprises an azide, azido, or azidomethyl group, including any of the potential features listed above.

In some embodiments, in the method for binding a nucleotide and in the method for incorporating a nucleotide and in the method for sequencing the nucleic acid template using nucleotides, the mutant polymerases is bound to a nucleic acid duplex comprising a nucleic acid template hybridized to a nucleic acid primer, thereby forming a complexed polymerase, wherein the nucleic acid template comprises a clonally-amplified template molecule or a single nucleic acid template molecule. In some embodiments, the nucleic acid primer comprises an extendible 3' terminal end or a non-extendible 3' terminal end. In some embodiments, any of the nucleic acid template, nucleic acid primer and/or polymerase is/are immobilized to a support.

In some embodiments, in the method for binding a nucleotide and in the method for incorporating a nucleotide and in the method for sequencing the nucleic acid template, the support comprises a planar or non-planar support. The support can be solid or semi-solid. In some embodiments, the support can be porous, semi-porous or non-porous. In some embodiments, the surface of the support can be coated with one or more compounds to produce a passivated layer on the support. In some embodiments, the passivated layer forms a porous or semi-porous layer. In some embodiments, the nucleic acid primer or template, or the polymerase, can be attached to the passivated layer to immobilize the primer, template and/or polymerase to the support. In some embodiments, the support comprises a low non-specific binding surface that enable improved nucleic acid hybridization and amplification performance on the support. In general, the support may comprise one or more layers of a covalently or non-covalently attached low-binding, chemical modification layers, e.g., silane layers, polymer films, and one or more covalently or non-covalently attached oligonucleotides that can be used for immobilizing a plurality of nucleic acid template molecules to the support. In some embodiments, the support can comprise a functionalized polymer coating layer covalently bound at least to a portion of the support via a chemical group on the support, a primer grafted to the functionalized polymer coating, and a water-soluble protective coating on the primer and the functionalized polymer coating. In some embodiments, the functionalized polymer coating comprises a poly(N-(5-azidoacetamidylpentyl)acrylamide-co-acrylamide (PAZAM). In some embodiments, the support comprises a surface coating having at least one hydrophilic polymer coating layer and at least one layer of a plurality of oligonucleotides. The hydrophilic polymer coating layer can comprise polyethylene glycol (PEG). The hydrophilic polymer coating layer can comprise branched PEG having at least 4 branches. In some embodiments, the support comprises a low non-specific binding coating having a water contact angle of no more than 45 degrees.

The present disclosure provides methods for determining the sequence of one or more nucleic acid template molecules, comprising: (a) contacting a plurality of a first mutant polymerase to (i) a plurality of nucleic acid template molecules and (ii) a plurality of nucleic acid primers, wherein the contacting is conducted under a condition suitable to bind the plurality of first mutant DNA polymerases to the plurality of nucleic acid template molecules and the plurality of nucleic acid primers thereby forming a plurality of first complexed polymerases each comprising a first mutant DNA polymerase bound to a nucleic acid duplex wherein the nucleic acid duplex comprises a nucleic acid template molecule hybridized to a nucleic acid primer. In some embodiments, the plurality of first mutant polymerases comprise a recombinant mutant polymerase. In some embodiments, the plurality of first mutant polymerases comprise a DNA polymerase. In some embodiments, the mutant polymerases include one or more example mutant polymerase features discussed above.

In some embodiments, in the methods for determining the sequence of one or more nucleic acid template molecules, the primer comprises a 3' extendible end or a 3' non-extendible end. In some embodiments, the plurality of nucleic acid template molecules may include the nucleic acid template embodiments, including any of the potential features listed above.

In some embodiments, the plurality of nucleic acid template molecules and/or the plurality of nucleic acid primers are in solution or are immobilized to a support. In some embodiments, when the plurality of nucleic acid template molecules and/or the plurality of nucleic acid primers are immobilized to a support, the binding with the first recombinant mutant polymerase generates a plurality of immobilized first complexed polymerases. In some embodiments, the plurality of nucleic acid template molecules and/or nucleic acid primers are immobilized to $10^2$-$10^{15}$ different sites on a support. In some embodiments, the binding of the plurality of template molecules and nucleic acid primers with the plurality of first recombinant mutant polymerases generates a plurality of first complexed polymerases immobilized to $10^2$-$10^{15}$ different sites on the support. In some embodiments, the plurality of immobilized first complexed polymerases on the support are immobilized to pre-determined or to random sites on the support. In some embodiments, the plurality of immobilized first complexed polymerases are in fluid communication with each other to permit flowing a solution of reagents (e.g., enzymes including polymerases, multivalent molecules, nucleotides, and/or divalent cations) onto the support so that the plurality of immobilized complexed polymerases on the support are reacted with the solution of reagents in a massively parallel manner.

In some embodiments, the methods for determining the sequence of one or more nucleic acid template molecules further comprises step (b): contacting the plurality of first complexed polymerases with a plurality of multivalent molecules to form a plurality of multivalent-complexed polymerases. In some embodiments, individual multivalent molecules in the plurality of multivalent molecules comprise a core attached to multiple nucleotide arms and each nucleotide arm is attached to a nucleotide (e.g., nucleotide unit). In some embodiments, the contacting of step (b) is conducted under a condition suitable for binding complementary nucleotide units of the multivalent molecules to at least two of the plurality of first complexed polymerases thereby forming a plurality of multivalent-complexed polymerases. In some embodiments, the condition is suitable for inhibiting incorporation of the complementary nucleotide units into the primers of the plurality of multivalent-complexed polymerases. In some embodiments, the plurality of multivalent molecules comprise at least one multivalent molecule having multiple nucleotide arms each attached with a nucleotide analog (e.g., nucleotide analog unit), where the nucleotide analog includes a chain terminating moiety at the sugar 2' and/or 3' position. In some embodiments, the plurality of multivalent molecules comprises at least one multivalent molecule comprising multiple nucleotide arms each attached with a nucleotide unit that lacks a chain terminating moiety. In some embodiments, at least one of the multivalent molecules in the plurality of multivalent molecules is labeled with a detectable reporter moiety. In some embodiments, the detectable reporter moiety comprises a fluorophore. In some embodiments, the contacting of step (b) is conducted in the presence of at least one cation selected from a group consisting of strontium, barium, sodium, magnesium, potassium, manganese, calcium, lithium, nickel and cobalt. In some embodiments, the contacting of step (b) is conducted in the presence of strontium, barium and/or calcium.

In some embodiments, the methods for determining the sequence of one or more nucleic acid template molecules, or for forming a plurality of complexed polymerases, further comprises step (c): detecting the plurality of multivalent-complexed polymerases. In some embodiments, the detecting includes detecting the multivalent molecules that are bound to the complexed polymerases, where the complementary nucleotide units of the multivalent molecules are bound to the primers but incorporation of the complementary nucleotide units is inhibited. In some embodiments, the multivalent molecules are labeled with a detectable reporter moiety to permit detection. In some embodiments, the labeled multivalent molecules comprise a fluorophore attached to the core and/or the base of the nucleotide unit of the multivalent molecules.

In some embodiments, the methods for determining the sequence of one or more nucleic acid template molecules, or for forming a plurality of complexed polymerases, further comprises step (d): identifying the base of the complementary nucleotide units that are bound to the plurality of first complexed polymerases, thereby determining the sequence of the nucleic acid template. In some embodiments, the multivalent molecules are labeled with a detectable reporter moiety that corresponds to the particular nucleotide units attached to the nucleotide arms to permit identification of the complementary nucleotide units (e.g., nucleotide base adenine, guanine, cytosine, thymine or uracil) that are bound to the plurality of first complexed polymerases.

In some embodiments, in the methods for determining the sequence of one or more nucleic acid template molecules, or for forming a plurality of complexed polymerases, In some embodiments, in the methods for determining the sequence of one or more nucleic acid template molecules, the method includes binding the plurality of first complexed polymerases with the plurality of multivalent molecules to form at least one avidity complex, the method comprising the steps: (a) contacting the plurality of DNA polymerases and the plurality of nucleic acid primers (which includes a first and second primer) with a first and second template molecule to form at least first and second complexed polymerases on the first and second template molecule, respectively; (b) contacting a plurality of multivalent molecules to the at least first and second complexed polymerases, under conditions suitable to bind a single multivalent molecule from the plurality to the first and second complexed polymerases, wherein at least a first nucleotide unit of the single multivalent molecule is bound to the first complexed polymerase which includes a first primer hybridized to the first template molecule thereby forming a first binding complex (e.g., first ternary complex), and wherein at least a second nucleotide unit of the single multivalent molecule is bound to the second complexed polymerase which includes a second primer hybridized to a second template molecule thereby forming a second binding complex (e.g., second ternary complex), wherein the contacting is conducted under a condition suitable to inhibit polymerase-catalyzed incorporation of the bound first and second nucleotide units in the first and second binding complexes, and wherein the first and second binding complexes which are bound to the same multivalent molecule forms an avidity complex; and (c) detecting the first and second binding complexes on the first and second template molecules, respectively, and (d) identifying the first nucleotide unit in the first binding complex thereby determining the sequence of the first template molecule, and identifying the second nucleotide unit in the second binding complex thereby determining the sequence of the second template molecule. In some embodiments, the plurality of DNA polymerases comprise any wild type or mutant polymerase described herein. The first and second template molecules are clonally amplified template molecules. In some embodiments, the first and second template molecules are localized in close proximity to each other. For example, the clonally-amplified first and second template molecules comprise linear template molecules that are generated via bridge amplification and are immobilized to the same location or feature on a support. The first and second template molecules comprise a sequence of interest and at least one universal sequencing primer binding site. The first and second nucleic acid primers can bind to a sequencing primer binding site on the first and second template molecules, respectively.

In some embodiments, the methods for determining the sequence of one or more nucleic acid template molecules further comprises step (e): dissociating the plurality of multivalent-complexed polymerases and removing the plurality of first mutant DNA polymerases and their bound multivalent molecules, and retaining the plurality of nucleic acid duplexes.

In some embodiments, the methods for determining the sequence of one or more nucleic acid template molecules further comprises step (f): contacting the plurality of the retained nucleic acid duplexes of step (e) with a plurality of second recombinant mutant DNA polymerases, wherein the contacting is conducted under a condition suitable for binding the plurality of second mutant DNA polymerases to the plurality of the retained nucleic acid duplexes, thereby forming a plurality of second complexed polymerases each comprising a second mutant DNA polymerase bound to a nucleic acid duplex. In some embodiments, the mutant polymerases include one or more example mutant polymerase features discussed above.

In some embodiments, the plurality of first mutant polymerases of step (a) have an amino acid sequence that is 100% identical to the amino acid sequence as the plurality of the second mutant polymerases of step (f). In some embodiments, the plurality of first mutant polymerases of step (a) have an amino acid sequence that differs from the amino acid sequence of the plurality of the second mutant polymerases of step (f).

In some embodiments, the methods for determining the sequence of one or more nucleic acid template molecules further comprises step (g): contacting the plurality of second complexed polymerases with a plurality of nucleotides, wherein the contacting is conducted under a condition suitable for binding complementary nucleotides from the plurality of nucleotides to at least two of the second complexed polymerases thereby forming a plurality of nucleotide-complexed polymerases. In some embodiments, the contacting of step (g) is conducted under a condition that is suitable for promoting incorporation of the bound complementary nucleotides into the primers of the nucleotide-complexed polymerases thereby forming a plurality of nucleotide-complexed polymerases. In some embodiments, the incorporating the nucleotide into the 3' end of the primer in step (g) comprises a primer extension reaction. In some embodiments, the contacting of step (g) is conducted in the presence of at least one cation selected from a group consisting of strontium, barium, sodium, magnesium, potassium, manganese, calcium, lithium, nickel and cobalt. In some embodiments, the contacting of step (g) is conducted in the presence of magnesium and/or manganese. In some embodiments, the plurality of nucleotides comprise native nucleotides (e.g., non-analog nucleotides) or nucleotide analogs. In some embodiments, the plurality of nucleotides comprise a 2' and/or 3' chain terminating moiety which is removable or is not removable. In some embodiments, the plurality of nucleotides comprises a plurality of nucleotides labeled with detectable reporter moiety. The detectable reporter moiety comprises a fluorophore. In some embodiments, the fluorophore is attached to the nucleotide base. In some embodiments, the fluorophore is attached to the nucleotide base with a linker which is cleavable/removable from the base or is not removable from the base. In some embodiments, at least one of the nucleotides in the plurality is not labeled with a detectable reporter moiety. In some embodiments, a particular detectable reporter moiety (e.g., fluorophore) that is attached to the nucleotide can correspond to the nucleotide base (e.g., dATP, dGTP, dCTP, dTTP or dUTP) to permit detection and identification of the nucleotide base.

In some embodiments, the methods for determining the sequence of one or more nucleic acid template molecules further comprise step (h): detecting the complementary nucleotides which are incorporated into the primers of the nucleotide-complexed polymerases. In some embodiments, the plurality of nucleotides are labeled with a detectable reporter moiety to permit detection. In some embodiments, in the methods for determining the sequence of one or more nucleic acid template molecules, the detecting step is omitted.

In some embodiments, the methods for determining the sequence of one or more nucleic acid template molecules further comprises step (i): identifying the bases of the complementary nucleotides which are incorporated into the primers of the nucleotide-complexed polymerases. In some embodiments, the identification of the incorporated complementary nucleotides in step (i) can be used to confirm the identity of the complementary nucleotides of the multivalent molecules that are bound to the plurality of first complexed polymerases in step (d). In some embodiments, the identifying of step (i) can be used to determine the sequence of the nucleic acid template molecules. In some embodiments, in the methods for determining the sequence of one or more nucleic acid template molecules, the identifying step is omitted.

In some embodiments, the methods for determining the sequence of one or more nucleic acid template molecules further comprises step (j): removing the chain terminating moiety from the incorporated nucleotide when step (g) is conducted by contacting the plurality of second complexed polymerases with a plurality of nucleotides that comprise at least one nucleotide having a 2' and/or 3' chain terminating moiety.

In some embodiments, the methods for determining the sequence of one or more nucleic acid template molecules further comprises step (k): repeating steps (a)-(j) at least once. In some embodiments, the sequence of the nucleic acid template molecules can be determined by detecting and identifying the multivalent molecules that bind the mutant polymerases but do not incorporate into the 3' end of the primer at steps (c) and (d). In some embodiments, the sequence of the nucleic acid template molecule can be determined (or confirmed) by detecting and identifying the nucleotide that incorporates into the 3' end of the primer at steps (h) and (i).

In some embodiments, in the methods for determining the sequence of one or more nucleic acid template molecules, at least one multivalent molecule in the plurality of multivalent molecules of step (b) may embody any of the multivalent molecule embodiments, including any of the potential features listed above.

In some embodiments, in the methods for determining the sequence of one or more nucleic acid template molecules, at least one multivalent molecule in the plurality of multivalent molecules of step (b) comprise a nucleotide unit having a chain of one, two or three phosphorus atoms where the chain is typically attached to the 5' carbon of the sugar moiety via an ester or phosphoramide linkage. In some embodiments, at least one nucleotide unit is a nucleotide analog having a phosphorus chain in which the phosphorus atoms are linked together with intervening O, S, NH, methylene or ethylene. In some embodiments, the phosphorus atoms in the chain include substituted side groups including O, S or $BH_3$. In some embodiments, the chain includes phosphate groups substituted with analogs including phosphoramidate, phosphorothioate, phosphorodithioate, and O-methylphosphoroamidite groups.

In some embodiments, in the methods for determining the sequence of one or more nucleic acid template molecules, individual multivalent molecules in the plurality of multivalent molecule of step (b) comprise a core attached to multiple nucleotide arms, and wherein individual nucleotide arms comprise a nucleotide unit having a chain terminating moiety (e.g., blocking moiety) at the sugar 2' position, at the sugar 3' position, or at the sugar 2' and 3' position.

In some embodiments, in the methods for determining the sequence of one or more nucleic acid template molecules, at least one multivalent molecule in the plurality of multivalent molecules of step (b) comprises a nucleotide unit comprising a terminator nucleotide analog that includes one or more example nucleotide analog features discussed above.

In some embodiments, in the methods for determining the sequence of one or more nucleic acid template molecules, at least one multivalent molecule in the plurality of multivalent molecules of step (b) comprises a nucleotide unit comprising a terminator nucleotide analog having a chain terminating moiety (e.g., blocking moiety) at the sugar 2' position, at the sugar 3' position, or at the sugar 2' and 3' position. In some embodiments the chain terminating moiety is attached to the 3'—OH sugar position via a cleavable moiety, which may include any of the chain terminating moiety embodiments described above. In some embodiments the chain terminating moiety comprises an azide, azido, or azidomethyl group, including any of the potential features listed above.

In some embodiments, in the methods for determining the sequence of one or more nucleic acid template molecules, at least one multivalent molecule in the plurality of multivalent molecules of step (b) comprises a core attached to multiple nucleotide arms, wherein the core is labeled with detectable reporter moiety. In some embodiments, the detectable reporter moiety comprises a fluorophore. In some embodiments, a particular detectable reporter moiety (e.g., fluorophore) that is attached to the multivalent molecule can correspond to the base (e.g., dATP, dGTP, dCTP, dTTP or dUTP) of the nucleotide unit to permit detection and identification of the nucleotide base. In some embodiments, at least one of the nucleotide arms of the multivalent molecule comprises a linker and/or nucleotide base that is attached to a fluorophore, and wherein the fluorophore which is attached to a given linker or nucleotide base corresponds to the nucleotide base (e.g., adenine, guanine, cytosine, thymine or uracil) of the nucleotide arm.

In some embodiments, in the methods for determining the sequence of one or more nucleic acid template molecules, at least one nucleotide arm of a multivalent molecule in the plurality of multivalent molecules of step (b) has a nucleotide unit that is attached to a detectable reporter moiety. In some embodiments, the detectable reporter moiety is attached to the nucleotide base. In some embodiments, the detectable reporter moiety comprises a fluorophore. In some embodiments, a particular detectable reporter moiety (e.g., fluorophore) that is attached to the multivalent molecule can correspond to the base (e.g., dATP, dGTP, dCTP, dTTP or dUTP) of the nucleotide unit to permit detection and identification of the nucleotide base.

In some embodiments, in the methods for determining the sequence of one or more nucleic acid template molecules, the core of a multivalent molecule of step (b) comprises an avidin-like moiety and the core attachment moiety comprises biotin. In some embodiments, the core comprises an streptavidin-type or avidin-type moiety which includes an avidin protein, as well as any derivatives, analogs and other non-native forms of avidin that can bind to at least one biotin moiety. Other forms of avidin moieties include native and recombinant avidin and streptavidin as well as derivatized molecules, e.g. non-glycosylated avidin and truncated streptavidins. For example, avidin moiety includes de-glycosylated forms of avidin, bacterial streptavidin produced by *Streptomyces* (e.g., *Streptomyces avidinii*), as well as derivatized forms, for example, N-acyl avidins, e.g., N-acetyl, N-phthalyl and N-succinyl avidin, and the commercially-available products ExtrAvidin™, Captavidin™, Neutravidin™, and Neutralite Avidin™.

In some embodiments, in the methods for determining the sequence of one or more nucleic acid template molecules, the each of the steps (a)-(j) are conducted at a temperature which is selected from a temperature range of about 25-75° C. In some embodiments, the contacting of steps (a) and (b) are conducted at a constant temperature which is selected from a temperature range of about 25-75° C. (e.g., isothermal temperature). In some embodiments, the detecting and identifying of steps (c) and (d) are conducted at a constant temperature which is selected from a temperature range of about 25-75° C. (e.g., isothermal temperature). In some embodiments, the dissociating of step (e) is conducted at a constant temperature which is selected from a temperature range of about 25-75° C. (e.g., isothermal temperature). In some embodiments, the contacting of steps (f) and (g) are conducted at a constant temperature which is selected from a temperature range of about 25-75° C. (e.g., isothermal temperature). In some embodiments, the detecting and identifying of steps (h) and (i) are conducted at a constant temperature which is selected from a temperature range of about 25-75° C. (e.g., isothermal temperature). In some embodiments, the removing of step (j) is conducted at a constant temperature which is selected from a temperature range of about 25-75° C. (e.g., isothermal temperature). In some embodiments, the steps (a)-(j) are conducted at a constant temperature which is selected from a temperature range of about 25-75° C. (e.g., isothermal temperature).

In some embodiments, in the methods for determining the sequence of one or more nucleic acid template molecules, at least one nucleotide in the plurality of nucleotides of step (g) comprise a base, sugar and at least one phosphate group. In some embodiments, at least one nucleotide in the plurality comprises a nucleotide unit that includes one or more example nucleotide unit features as discussed above. In some embodiments, at least one nucleotide in the plurality is not a nucleotide analog. In some embodiments, at least one nucleotide in the plurality comprises a nucleotide analog.

In some embodiments, in the methods for determining the sequence of one or more nucleic acid template molecules, at least one nucleotide in the plurality of nucleotides of step (g) comprise a chain of one, two or three phosphorus atoms where the chain is typically attached to the 5' carbon of the sugar moiety via an ester or phosphoramide linkage. In some embodiments, at least one nucleotide in the plurality is an analog having a phosphorus chain in which the phosphorus atoms are linked together with intervening O, S, NH, methylene or ethylene. In some embodiments, the phosphorus atoms in the chain include substituted side groups including O, S or $BH_3$. In some embodiments, the chain includes phosphate groups substituted with analogs including phosphoramidate, phosphorothioate, phosphorodithioate, and O-methylphosphoroamidite groups.

In some embodiments, in the methods for determining the sequence of one or more nucleic acid template molecules, at least one nucleotide in the plurality of nucleotides of step (g) comprises a terminator nucleotide analog that includes one or more example nucleotide analog features discussed above.

In some embodiments, in the methods for determining the sequence of one or more nucleic acid template molecules, at least one nucleotide in the plurality of nucleotides of step (g) comprises a terminator nucleotide analog having a chain terminating moiety (e.g., blocking moiety) at the sugar 2' position, at the sugar 3' position, or at the sugar 2' and 3' position. The chain terminating moiety can be attached to the 3'—OH sugar position via a cleavable moiety, which may include any of the chain terminating moiety embodiments described above. In some embodiments the chain terminating moiety comprises an azide, azido, or azidomethyl group, including any of the potential features listed above.

In some embodiments, in the methods for determining the sequence of one or more nucleic acid template molecules, at least one nucleotide in the plurality of nucleotides of step (g) comprises detectable reporter moiety (e.g., at least one labeled nucleotide). The detectable reporter moiety comprises a fluorophore. In some embodiments, the fluorophore is attached to the nucleotide base. In some embodiments, the fluorophore is attached to the nucleotide base with a linker which is cleavable/removable from the base. In some embodiments, at least one of the nucleotides in the plurality is not labeled with a detectable reporter moiety. In some embodiments, a particular detectable reporter moiety (e.g., fluorophore) that is attached to the nucleotide can correspond to the nucleotide base (e.g., dATP, dGTP, dCTP, dTTP or dUTP) to permit detection and identification of the nucleotide base.

In some embodiments, in the methods for determining the sequence of one or more nucleic acid template molecules, at least one nucleotide in the plurality of nucleotides of step (g) comprises a cleavable linker on the base which comprises having a chain terminating moiety attached to the 3'—OH sugar position via a cleavable moiety, which may include any of the chain terminating moiety embodiments described above. In some embodiments the chain terminating moiety comprises an azide, azido, or azidomethyl group, including any of the potential features listed above.

In some embodiments, in the methods for determining the sequence of one or more nucleic acid template molecules, the support comprises a planar or non-planar support. The support can be solid or semi-solid. In some embodiments, the support can be porous, semi-porous or non-porous. In some embodiments, the surface of the support can be coated with one or more compounds to produce a passivated layer on the support. In some embodiments, the passivated layer forms a porous or semi-porous layer. In some embodiments, the nucleic acid primer, template and/or polymerase, can be attached to the passivated layer to immobilize the primer, template and/or polymerase to the support. In some embodiments, the support comprises a low non-specific binding surface that enable improved nucleic acid hybridization and amplification performance on the support. In general, the support may comprise one or more layers of a covalently or non-covalently attached low-binding, chemical modification layers, e.g., silane layers, polymer films, and one or more covalently or non-covalently attached oligonucleotides that can be used for immobilizing a plurality of nucleic acid template molecules to the support. In some embodiments, the support can comprise a functionalized polymer coating layer covalently bound at least to a portion of the support via a chemical group on the support, a primer grafted to the functionalized polymer coating, and a water-soluble protective coating on the primer and the functionalized polymer coating. In some embodiments, the functionalized polymer coating comprises a poly(N-(5-azidoacetamidylpentyl)acrylamide-co-acrylamide (PAZAM). In some embodiments, the support comprises a surface coating having at least one hydrophilic polymer coating layer and at least one layer of a plurality of oligonucleotides. The hydrophilic polymer coating layer can comprise polyethylene glycol (PEG). The hydrophilic polymer coating layer can comprise branched PEG having at least 4 branches. In some embodiments, the support comprises a low non-specific binding coating having a water contact angle of no more than 45 degrees. In some embodiments, the density of the plurality of first complexed polymerases immobilized to the support or immobilized to the coating on the support is about $10^2$-$10^6$ per $mm^2$, or about $10^6$-$10^9$ per $mm^2$, or about $10^9$-$10^{12}$ per $mm^2$. In some embodiments, the plurality of first complexed polymerases is immobilized to the support or immobilized to the coating on the support at pre-determined sites on the support (or the coating on the support), or immobilized to the coating on the support at random sites on the support (or the coating on the support).

EXAMPLES

The following examples are meant to be illustrative and can be used to further understand embodiments of the present disclosure and should not be construed as limiting the scope of the present teachings in any way.

Example 1

Clarified Lysate Preparation of Mutant Polymerases

Mutant polymerases were prepared using site directed mutagenesis. The mutated sites of the mutant polymerases are listed in Table 1 (FIG. 3-1 through FIG. 3-8), Table 2 (FIG. 4-1 through FIG. 4-5) and Table 3 (FIG. 5-1 through FIG. 5-5).

Host cells harboring an expression vector operably linked to a nucleic acid encoding one of the mutant polymerases were prepared. The host cells were cultured under conditions suitable for expressing the mutant polymerase. The host cells were grown in plate format and centrifuged after expression. Cell pellets were lysed by treatment with lysozyme in buffer (20 mM Tris-HCl (pH 8.8), 10 mM KCl, 10 mM $(NH_4)_2SO_4$)) and centrifuged again. The supernatants were transferred to PCR plates and heat shocked at 60° C. for 30 minutes. The heat shocked lysates were then clarified by centrifuge and the supernatants transferred to a new plate for the nucleotide incorporation assay.

Example 2

Nucleotide Incorporation Assay

Atto dye-labeled DNA templates were used to prepare the DNA duplexes. The labeled DNA templates were annealed with primers in a reaction buffer (Tris-HCl (pH 7.5), NaCl, EDTA). The duplexes were mixed with the clarified lysates (described in Example 1) and allowed to equilibrate to 42° C. The nucleotide incorporation reaction was started with the addition of a 3' methylazido nucleotide corresponding to the next base on the template (e.g., dCTP-N3). The reaction was allowed to proceed at 42° C. for 30 seconds and quenched with EDTA and formamide. The analysis of the n+1 vs n was performed by capillary electrophoresis.

Table 1 (FIG. 3-1 through FIG. 3-8), Table 2 (FIG. 4-1 through FIG. 4-5) and Table 3 (FIG. 5-1 through FIG. 5-5), list the relative activity of variants of DNA polymerase from Candidatus Altiarchaeales archaeon in incorporation of 3'methylazido nucleotides at the N+1 position of an extending polynucleotide chain at 42° C.

The results are shown in Table 1 (FIG. 3-1 through FIG. 3-8), Table 2 (FIG. 4-1 through FIG. 4-5) and Table 3 (FIG. 5-1 through FIG. 5-5. In Table 1 (FIG. 3-1 through FIG. 3-8), the wild type polymerase from Candidatus Altiarchaeales archaeon was designated #1 (e.g., SEQ ID NO: 1). The mutant polymerase clones from Candidatus Altiarchaeales archaeon were designated #2-80 (e.g., SEQ ID NOS: 2-80, respectively; see also Table 1, FIG. 3-1 through FIG. 3-83) contained the following mutations: 2: Y502V, 3: Y502S, 4: Y502Q, 5: Y502P, 6: Y502H, 7: Y502G, 8: Y502F, 9: Y502A, 10: S415V, 11: 5415G, 12: S415A, 13: R468V, 14: R468S, 15: R468K, 16: R468H, 17: R468G, 18: R468A, 19: R414S, 20: L416V, 21: L416S, 22: L416A, 23: I529V, 24: I529S, 25: I529H, 26: I529G, 27: I529A, 28: Y417V_P418V, 29: Y417V_P418S, 30: Y417V_P418A, 31: Y417T_P418K, 32: Y417S_P418S, 33: Y417S_P418G, 34: Y417S_P418A, 35: Y417G_P418V, 36: Y417G_P418S, 37: Y417G_P418G, 38: Y417G_P418C, 39: Y417G_P418A, 40: Y417A_P418V, 41: Y417A_P418S, 42: Y417A_P418G, 43: Y417A_P418A, 44: S415V_Y417S, 45: S415V_Y417A, 46: S415V_P418V, 47: S415V_P418S, 48: S415V_P418G, 49: S415V_L416V, 50: S415V_L416S, 51: S415G_Y417V, 52: S415G_Y417S, 53: S415G_P418V, 54: S415G_P418S, 55: S415G_P418G, 56: S415G_P418A, 57: S415G_L416V, 58: S415G_L416S, 59: S415G_L416G, 60: S415G_L416A, 61: S415A_Y417G, 62: S415A_Y417A, 63: S415A_P418G, 64: S415A_L416S, 65: L416V_P418S, 66: L416V_P418G, 67: L416S_Y417G, 68: L416S_Y417A, 69: L416S_P418V, 70: L416S_P418G, 71: L416G_Y417G, 72: L416G_Y417A, 73: L416G_P418G, 74: L416G_P418A, 75: L416A_Y417S, 76: L416A_P418S, 77: L416A_P418G, 78: L416A_P418A, 79: Y417V_P418V_Y502S, 80: Y417V_P418G_Y502G.

In Table 1 (FIG. 3-1 through FIG. 3-83), the mutant polymerase clones from Candidatus Altiarchaeales archaeon were designated #81-157 (e.g., SEQ ID NOS: 81-157, respectively) contained the following mutations: 81: Y417V_P418A_Y502R, 82: Y417S_P418V_Y502R, 83: Y417S_P418G_Y502S, 84: Y417G_P418G_Y502V, 85: Y417G_P418A_Y502N, 86: Y417G_P418A_Y502G, 87: Y417A_P418S_Y502R, 88: G403A_H405S_D406H, 89: A493V_K495V_N499S, 90: A493V_K495V_N499G, 91: A493V_K495V_N499A, 92: A493V_K495S_N499V, 93: A493V_K495S_N499S, 94: A493V_K495S_N499G, 95: A493V_K495Q_N499V, 96: A493V_K495Q_N499G, 97: A493V_K495Q_N499A, 98: A493V_K495G_N499V, 99: A493V_K495G_N499S, 100: A493V_K495G_N499G, 101: A493V_K495G_N499A, 102: A493V_K495A_N499G, 103: A493V_K495A_N499A, 104: A493V_K495S_N499G, 105: L416A_Y417A_P418A, 106: L416A_Y417A_P418G, 107: L416A_Y417A_P418I, 108: L416A_Y417S_P418A, 109: L416A_Y417S_P418G, 110: L416A_Y417S_P418S, 111: L416G_Y417G_P418G, 112: L416I_Y417A_P418G, 113: L416I_Y417A_P418S, 114: L416I_Y417G_P418A, 115: L416I_Y417I_P418V, 116: L416S_Y417A_P418G, 117: L416S_Y417G_P418A, 118: L416T_Y417A_P418A, 119: L416T_Y417G_P418A, 120: L416V_Y417A_P418A, 121: L416V_Y417G_P418G, 122: L416I_Y417S_P418S, 123: L416V_Y417V_P418G, 124: H405P_A493V_K495G_N499A, 125: A493V_K495S_N499A_Y502T, 126: A493V_K495Q_N499G_F507S, 127: A493V_K495G_N499G_M501I, 128: L416A_Y417A_P418A_I529L, 129: L416A_Y417A_P418A_I529H, 130: L416A_Y417A_P418S_I529H, 131: L416A_Y417G_P418A_I529H, 132: L416A_Y417G_P418G_I529H, 133: L416A_Y417G_P418S_I529H, 134: L416G_Y417T_P418S_I529H, 135:

L416I_Y417A_P418A_I529L, 136: L416I_Y417A_P418G_I529F, 137: L416I_Y417A_P418S_I529H, 138: L416I_Y417G_P418A_I529L, 139: L416I_Y417S_P418G_I529H, 140: L416L_Y417Y_P418P_I529H, 141: L416S_Y417A_P418G_I529H, 142: L416S_Y417A_P418G_I529F, 143: L416S_Y417A_P418T_I529H, 144: L416S_Y417G_P418G_I529H, 145: L416S_Y417G_P418V_I529H, 146: L416T_Y417A_P418A_I529H, 147: L416T_Y417A_P418G_I529H, 148: L416T_Y417G_P418A_I529H, 149: L416V_Y417A_P418A_I529H, 150: L416V_Y417A_P418G_I529S, 151: L416V_Y417A_P418G_I529T, 152: L416V_Y417A_P418G_I529H, 153: L416V_Y417A_P418S_I529H, 154: L416V_Y417G_P418A_I529H, 155: L416V_Y417G_P418G_I529H, 156: L416V_Y417G_P418S_I529H, 157: L416V_Y417T_P418S_I529H.

In Table 2 (FIG. 4-1 through FIG. 4-5), the mutant polymerase clones from Candidatus Altiarchaeales archaeon were designated #158-255 (e.g., SEQ ID NOS: 158-255) contained the following mutations: 158: Y502I, 159: L416A_Y417G_P418A, 160: L416I_Y417A_P418A, 161: L416V_Y417A_P418G, 162: L416A_Y417A_P418S, 163: L416I_Y417S_P418G, 164: L416V_Y417A_P418S, 165: L416A_Y417I_P418T, 166: L416S_Y417G_P418V, 167: L416S_Y417G_P418G, 168: L416V_Y417G_P418A, 169: L416A_Y417A_P418V, 170: L416V_Y417T_P418I, 171: L416V_Y417V_P418A, 172: S415V_Y417A_A493V_K495G_N499S, 173: H405P_A493V_K495V_N499A, 174: A493V_K495S_N499G_F507S, 175: L416S_Y417A_P418G_I529H_R608K, 176: L416S_Y417A_P418G_I529H_K473A, 177: L416S_Y417A_P418G_I529H_L496A, 178: L416S_Y417A_P418G_I529H_V489I, 179: L416S_Y417A_P418G_I529H_R515L, 180: L416S_Y417A_P418G_I529H_A493S, 181: L416S_Y417A_P418G_I529H_D622T, 182: L416S_Y417A_P418G_I529H_Q492R, 183: L416S_Y417A_P418G_I529H_Q673I, 184: L416S_Y417A_P418G_I529H_A493S_D622T, 185: L416S_Y417A_P418G_I529H_A493S_Q492R, 186: L416S_Y417A_P418G_I529H_K473A_L496A, 187: L416S_Y417A_P418G_I529H_K473A_Q492R, 188: L416S_Y417A_P418G_I529H_K473A_R515L, 189: L416S_Y417A_P418G_I529H_L496A_A493S_Q492R, 190: L416S_Y417A_P418G_I529H_L496A_A493S_V489I, 191: L416S_Y417A_P418G_I529H_L496A_R515L, 192: L416S_Y417A_P418G_I529H_L496A_V489I, 193: L416S_Y417A_P418G_I529H_Q492R_P335Q, 194: L416S_Y417A_P418G_I529H_Q492R_Q673I, 195: L416S_Y417A_P418G_I529H_R515L_Q492R, 196: L416S_Y417A_P418G_I529H_R515L_Q673I, 197: L416S_Y417A_P418G_I529H_R608K_A493S, 198: L416S_Y417A_P418G_I529H_R608K_L496A, 199: L416S_Y417A_P418G_I529H_R608K_Q492R, 200: L416S_Y417A_P418G_I529H_V489I_A493S, 201: L416S_Y417A_P418G_I529H_V489I_Q492R, 202: L416S_Y417A_P418G_I529H_V489I_R515L, 203: L416S_Y417A_P418G_I529H_A493S_R515L, 204: L416S_Y417A_P418G_A493S_I529H_K610E, 205: L416S_Y417A_P418G_I529H_A493S_L496G, 206: L416S_Y417A_P418G_I529H_A493S_R515L_L611S, 207: L416S_Y417A_P418G_I529H_A493S_L496S_D439S, 208: L416S_Y417A_P418G_I529H_A493S_R515W, 209: L416S_Y417A_P418G_I529H_A493S_L496A, 210: L416S_Y417A_P418G_I529H_A493S_Q492C_L496R, 211: L416S_Y417A_P418G_I529H_A493S_R723H, 212: L416S_Y417A_P418G_I529H_A493S_D653G_A669D_S717G_I750V, 213: L416S_Y417A_P418G_I529H_A493S_L496S, 214: L416S_Y417A_P418G_I529H_A493S_R515Y, 215: L416S_Y417A_P418G_I529H_A493S_Q492G_L496A, 216: L416S_Y417A_P418G_I529H_A493S_S443N_Q492F, 217: L416S_Y417A_P418G_I529H_A493S_R697G, 218: L416S_Y417A_P418G_I529H_A493S_L496H, 219: L416S_Y417A_P418G_I529H_A493S_Q492A_L496S, 220: L416S_Y417A_P418G_I529H_A493S_L494V_L496N, 221: L416S_Y417A_P418G_I529H_A493S_V651M, 222: L416S_Y417A_P418G_A493S_I529H_E569G, 223: L416S_Y417A_P418G_I529H_A493S_R515L_S717G, 224: L416S_Y417A_P418G_I529H_A493S_S717G, 225: L416S_Y417A_P418G_I529H_A493S_R515L_N567D, 226: L416S_Y417A_P418G_I529H_A493S_L496R, 227: L416S_Y417A_P418G_I529H_A493S_Q492G, 228: L416S_Y417A_P418G_I529H_A493S_R515L_S577I, 229: L416S_Y417A_P418G_A493S_I529H_K58M, 230: L416S_Y417A_P418G_I529H_A493S_R515P, 231: L416S_Y417A_P418G_I529H_A493S_Q492G_L496I, 232: L416S_Y417A_P418G_I529H_A493S_L496N, 233: L416S_Y417A_P418G_I529H_A493S_R515F, 234: L416S_Y417A_P418G_I529H_A493S_D381Y_Q492R_L496M, 235: L416S_Y417A_P418G_I529H_A493S_S443N, 236: L416S_Y417A_P418G_I529H_A493S_E370D, 237: L416S_Y417A_P418G_I529H_A493S_E760G, 238: L416S_Y417A_P418G_I529H_A493S_Q492T_L496S, 239: L416S_Y417A_P418G_I529H_A493S_L496C, 240: L416S_Y417A_P418G_I529H_A493S_L496I, 241: L416S_Y417A_P418G_I529H_A493S_L496Y, 242: L416S_Y417A_P418G_I529H_A493S_G355S_S440N_R515L, 243: L416S_Y417A_P418G_I529H_A493S_Q492L_L496M, 244: L416F_Y417A_P418G_A493S_I529H_R515L_N567D, 245: L416Y_Y417A_P418G_A493S_I529H_R515L_N567D, 246: L416S_Y417T_P418G_I529H_A493S_R515L_N567D, 247: L416M_Y417A_P418G_A493S_I529H_R515L_N567D, 248: L416A_Y417A_P418G_I529H_A493S_R515L_N567D, 249: L416S_Y417A_P418G_I529H_A493S_R515L_N567D_C104S, 250: L416S_Y417A_P418G_I529H_A493S_R515L_N567D_C514S, 251: L416S_Y417A_P418G_I529H_A493S_R515L_N567D_C130S, 252: L416S_Y417A_P418G_I529H_A493S_R515L_N567D_C130R, 253: L416S_Y417A_P418G_I529H_A493S_R515L_N567D_C450S, 254:

L416S_Y417A_P418G_I529H_A493S_R515L_N567D_C517S, 255: L416S_Y417A_P418G_I529H_A493S_R515L_N567D_C269S.

Example 3

Mutant Polymerases from *Geobacillus stearothermophilus*

Figure 2:
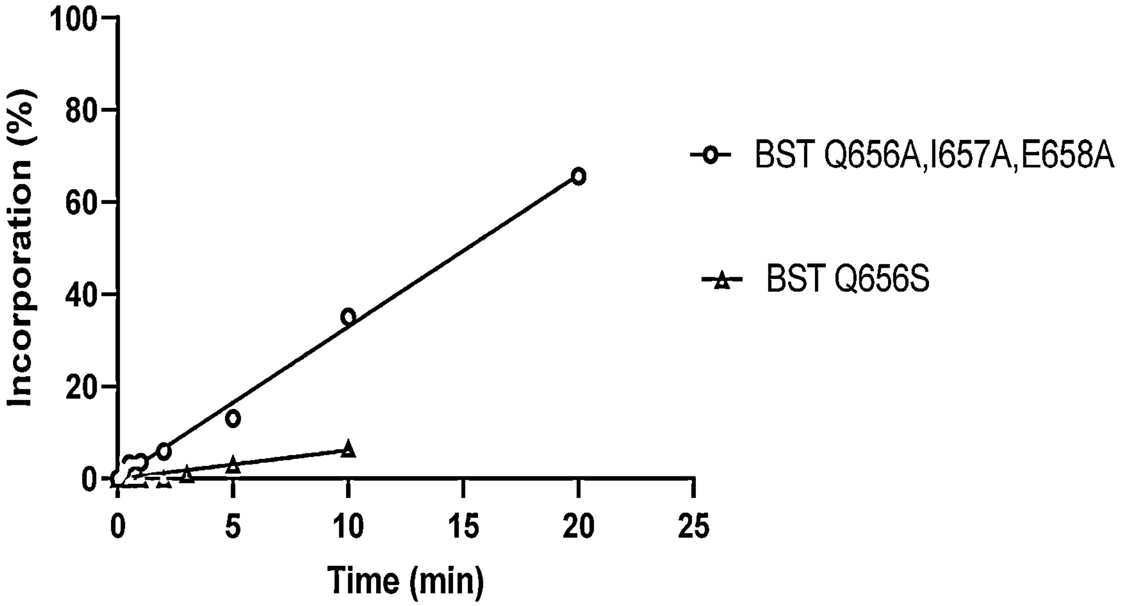
FIG. 2 is a graph showing the relative incorporation percent of 3'-methylazido nucleotides by variants of a Bst polymerase (e.g., a DNA polymerase I from *Geobacillus stearothermophilus*).

Mutations R615K, Y654A, Y654D, Y654E, Y654F, Y654G, S655A, S655G, S655V, Q656A, Q656G, Q656N, Q656S, Q656V, I657A, I657G, I657S, I657V, E658A, E658D, E658G, E658S, E658V, L659A, L659G, L659P, L659S, L659V, D680A, D680G, D680I, D680L, D680N, D680S, D680V, H682A, H682G, H682N, H682Q, H682S, H682V, R702A, R702G, R702H, R702K, R702S, R702V, K706H, K706K, K706R, A707G, A707S, A707T, F710A, F710D, F710E, F710G, F710Q, F710S, F710T, F710V, Y714A, Y714D, Y714E, Y714F, Y714G, Y714S, Y714W, H829A, H829G, D314E, I332L, I334L, K368R, K381R, I385L, K417R, K434R, I454L, D471E, I528L, K601R, K635R, I649L, I665L, K758R, and K760R were made either individually or in various combinations in Bst polymerase (e.g., *Geobacillus stearothermophilus*). The improvement in incorporation of 3'-azidomethyl nucleotides by representative Bst variants is shown in FIG. 2.

Example 4

Rate Reaction

Figure 19:
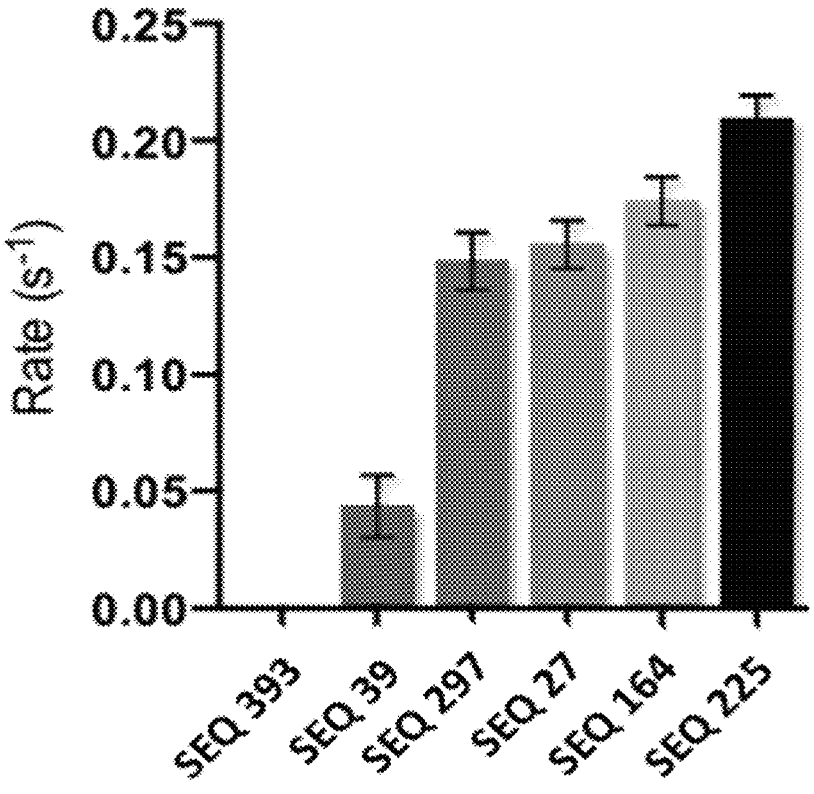
FIG. 19 is a bar graph comparing the rate of product formation of purified wild-type and mutant DNA polymerases from Candidatus Altiarchaeales archaeon in the presence of 3'methylazido dCTP. The graph shows data for mutant polymerases having amino acid sequences of SEQ ID NOS: 39, 297, 27, 164 or 225.

Purified enzymes were pre-incubated in reaction buffer at 42° C. in excess with annealed substrate DNA containing a dG at the templating position. Reactions were started by addition of correct dCTP-3'-O-methylazido nucleotide and allowed to proceed. At various time points, reactions were sampled and quenched by addition of EDTA and formamide to stop the reaction. Quenched samples were analyzed by capillary electrophoresis. Product formation vs. time was fitted to an exponential equation to derive an apparent reaction rate. The results are shown in FIG. 19 which compares wild type enzyme (SEQ ID NO: 1) with engineered enzymes having amino acid sequences of SEQ ID NOS: 39, 297, 27, 164 or 225.

Example 5

Primer Extension Reactions

Figure 20:
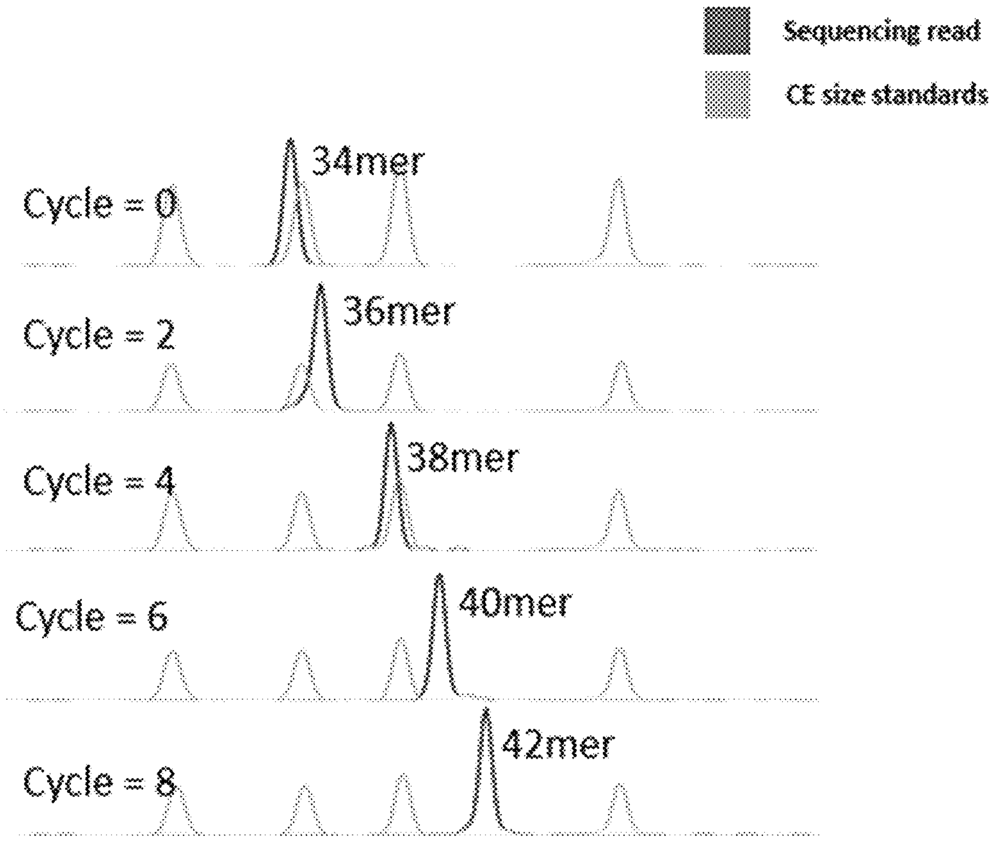
FIG. 20 is a series of graphs showing the results of primer extension reactions on polonies immobilized to a flowcell, using an engineered polymerase (e.g., SEQ ID NO: 27), where the length of the extension product was monitored by capillary electrophoresis.

Flowcells were prepared having spatially separated and individually contained fields of amplified polonies for sequencing. In a controlled fashion, extension mix containing appropriate buffer, an engineered polymerase (e.g., SEQ ID NO: 27), dNTP-3'-O-methylazido, and catalytic metal was allowed to react with the amplified polonies to incorporate ideally a single nucleotide to the 3' end of the sequencing primer of N length. Reactions were stopped by removal of the solution and extensive washing. Blocked sequencing primers corresponding to an extension product of N+1 were then reacted with cleavage reagent to remove the methylazido blocking group and regenerate an extendible 3'OH group. Following cleavage the amplified polonies were extensively washed to remove any trace cleavage reagent. The process was repeated 2, 4, 6, 8 times such that each spatially separated field of amplified polonies were extended to N+1,N+4,N+6,N+8. Extended sequencing primers were then removed and analyzed by capillary electrophoresis. The results are shown in FIG. 20.

Example 6

Sequencing Using Multivalent Molecules and Nucleotides

A two-stage sequencing reaction was conducted on a flow cell having a plurality of concatemer template molecules immobilized thereon (e.g., immobilized polonies).

The first-stage sequencing reaction was conducted by hybridizing a plurality of a soluble sequencing primers to concatemer template molecules that were immobilized to a flow cells to form immobilized primer-concatemer duplexes. A plurality of a first sequencing polymerase was flowed onto the flow cell (e.g., contacting the immobilized primer-concatemer duplexes) and incubated under a condition suitable to bind the sequencing polymerase to the duplexes to form complexed polymerases. Exemplary first sequencing polymerases comprise an amino acid sequence of any one of SEQ ID NOS: 1-274 or 288-375 or 385-397. A mixture of fluorescently labeled multivalent molecules (e.g., at different concentrations of about 20-100 nM) was flowed onto the flow cell in the presence of a buffer that included a non-catalytic cation (e.g., strontium, barium and/or calcium) and incubated under conditions suitable to bind complementary nucleotide units of the multivalent molecules to the complexed polymerases to form avidity complexes without polymerase-catalyzed incorporation of the nucleotide units. The fluorescently labeled multivalent molecules were labeled at their cores. The complexed polymerases were washed. An image was obtained of the fluorescently labeled multivalent molecules that remained bound to the complexed polymerases. The first sequencing polymerases and multivalent molecules were removed, while retaining the sequencing primers hybridized to the immobilized concatemers (retained duplexes), by washing with a buffer comprising a detergent.

The first stage sequencing reaction was suitable for forming a plurality of avidity complexes on the concatemer template molecules (e.g., polonies). For example, the first stage sequencing reaction comprised: (a) binding a first nucleic acid primer, a first polymerase, and a first multivalent molecule to a first portion of a concatemer template molecule thereby forming a first binding complex, wherein a first nucleotide unit of the first multivalent molecule was bound to the first polymerase; and (b) binding a second nucleic acid primer, a second polymerase, and the first multivalent molecule to a second portion of the same concatemer template molecule thereby forming a second binding complex, wherein a second nucleotide unit of the first multivalent molecule was bound to the second polymerase, wherein the first and second binding complexes which included the same multivalent molecule formed a first avidity complex.

The second-stage sequencing reaction was conducted by contacting the retained duplexes with a plurality of second sequencing polymerases to form complexed polymerases. Exemplary second sequencing polymerases comprise an amino acid sequence of any one of SEQ ID NO: 1-274 or 288-375 or 385-397. A mixture of non-labeled nucleotide analogs (e.g., 3'O-methylazido nucleotides) (e.g., at different concentrations of about 1-5 uM) was added to the complexed polymerases in the presence of a buffer that included a catalytic cation (e.g., magnesium and/or manganese) and incubated under conditions suitable to bind complementary nucleotides to the complexed polymerases and promote polymerase-catalyzed incorporation of the nucleotides to generate a nascent extended sequencing primer. The complexed polymerases were washed. No image was obtained. The incorporated non-labeled nucleotide analogs were reacted with a cleaving reagent that removes the 3' O-methylazido group and generates an extendible 3'OH group.

In an alternative second stage sequencing reaction, a mixture of fluorescently labeled nucleotide analogs (e.g., 3'O-methylazido nucleotides) (e.g., about 1-5 uM) was added to the complexed polymerases in the presence of a buffer that included a catalytic cation (e.g., magnesium and/or manganese) and incubated under conditions suitable to bind complementary nucleotides to the complexed polymerases and promote polymerase-catalyzed incorporation of the nucleotides to generate a nascent extended sequencing primer. The complexed polymerases were washed. An image was obtained of the incorporated fluorescently labeled nucleotide analogs as a part of the complexed polymerases. The incorporated fluorescently labeled nucleotide analogs were reacted with a cleaving reagent that removes the 3' O-methylazido group and generates an extendible 3'OH group.

The second sequencing polymerases were removed, while retaining the nascent extended sequencing primers hybridized to the concatemers (retained duplexes), by washing with a buffer comprising a detergent. Recurring sequencing reactions were conducted by performing multiple cycles of first-stage and second-stage sequencing reactions to generate extended forward sequencing primer strands. Exemplary phasing rate obtained from a 36-cycle sequencing run is shown in FIG. 20.

SEQUENCE LISTING (399 sequences)

SEQ ID NO: 1 - protein, 773 aa, Unknown
  Description of Unknown: Candidatus Altiarchaeales archaeon sequence
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFDMEVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSLYPSIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 2 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFALAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSFAGSIIISHNIDPSTIDCECCPEDSYRSPTGHYFCKKKRGLIPETLNELVQRRIEVKKGLKNEKNPERRRFLDVKQQSLKLLANSMYGYFGFPRARWYCLECAESITALGRKYHLHTIDIVPKFGFDVIYGDTDSVYLIKPNITDRERVMKDAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 3 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSASSSIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 4 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSLYPSIIISHNIDPSTIDCECCPEDSYRSPTGHYFCKKKRGLIPETLNELVQRRIEVKKGLKNEKNPERRRFLDVKQQALKLLANSMIGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 5 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSTGASIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 6 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSSAGSIIISHNIDPSTIDCECCPEDSYRNPTGHYFCKKKRGLIPETLNELVQRRIEVKKGLKNEKNPERRRFLDVKQQSLKLLANSMYGYFGFPRARWYCRECAESITALGRKYHLHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 7 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSSAGSIIISHNIDPSTIDCECCPEDSYRSPTGHYFCKKKRGLIPETLNELVQRRIEVKKGLKNEKNPERRRFLDVKQASLKSLANSMYGYFGFPRARWYCRECAESITALGRKYHLHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 8 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSSAGSIIISHNIDPSTIDCECCPEDSYRSPTGHYFCKKKRGLIPETLNELVQRRIEVKKGLKNEKNPERRRFLDVKQQSLKNLANSMYGYFGFPRARWYCRECAESITALGRKYHLHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 9 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSLGGSIIISHNIDPSTIDCECCPEDSYRSPTGHYFCKKKRGLIPETLNELVQRRIEVKKGLKNEKNPERRRFLDVKQQALKLLANSMVGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 10 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNTTNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSFAGSIIISHNIDPSTIDCECCPEDSYRSPTGHYFCKKKRGLIPETLNELVQRRIEVKKGLKNEKNPERRRFLDVKQQSLKLLANSMYGYFGFPRARWYCLECAESITALGRKYHLHTIDIVPKFGFDVIYGDTDSVYLIKPNITDRERVMKDAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 11 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRALYPSIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 12 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSGTSSIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYHLHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 13 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRALYGSIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 14 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWNNPEKEKFKELIEYAMSDAESTLQIAITLLPLHYEISRITRELIYQSSRAGSGQRVESLLIKKAFEKSILVPNRPSDRVVNERQRKTYIGAYVVEPKRGIHDNILLFDFRSFAGSIIISHNIDPSTIDCECCPEDSYRSPTGHYFCKKKRGLIPETLNELVQRRIEVKKGLKNEKNPERRRFLDVKQQSLKLLANSMYGYFGFPRARWYCLECAESITALGRKYHLHTIDIVPKFGFDVIYGDTDSVYLIKPNITDRERVMKDAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 15 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSFAGSIIISHNIDPSTIDCRCCPEDSYRSPTGHYFCKKKRGLIPETLNELVQRRIEVKKGLKNEKNPERRRFLDVKQQSLKLLANSMYGYFGFPRARWYCLECAESITALGRKYHLHTIDIVPKFGFDVIYGDTDSVYLIKPNITDRERVMKDAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 16 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSLAGSIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 17 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRVTRELIYQSSRAGSGQRVESLLIKKAFEKSILVPNRPSDRVVNERQRKTYIGAYVVEPKRGIHDNILLFDFRSFAGSIIISHNIDPSTIDCECCPEDSYRSPTGHYFCKKKRGLIPETLNELVQRRIEVKKGLKNEKNPERRRFLDVKQQSLKLLANSMYGYFGFPRARWYCLECAESITALGRKYHLHTIDIVPKFGFDVIYGDTDSVYLIKPNITDRERVMKDAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 18 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSFAGSIIISHNIDPSTIDCECCPEDSYRSPTGHYFCKKKRGLIPETLNELVQRRIEVKKGLKNEKNPERRRFLDVKQQSLKLLANSIYGYFGFPRARWYCLECAESITALGRKYHLHTIDIVPKFGFDVIYGDTDSVYLIKPNITDRERVMKDAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGDIVTYVVTKKGKSISDKARVIDFVEEGDYDPDYYINNQVLPSVLRILEALGYSEDELKGLGKQMKLGGF

SEQ ID NO: 19 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSGGPSIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 20 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSSAGSIIISHNIDPSTIDCECCPEDSYRSPTGHYFCKKKRGLIPETLNELVQRRIEVKKGLKNEKNPERRRFLDVKQQSLKLLANSMYGYFGFPRARWYCLECAESITALGRKYHLHTIDIVPKFGFDVIYGDTDSVYLIKPNITDRERVMKNAEHFLDKINIELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 21 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSVGASIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 22 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSFAGSIIISHNIDPSTIDCECCPEDSYRSPTGHYFCKKKRGLIPETLNELVQRRIEVKKGLKNEKNPERRRFLDVKQQSLKLLANSVYGYFGFPRARWYCLECAESITALGRKYHLHTIDIVPKFGFDVIYGDTDSVYLIKPNITDRERVMKDAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 23 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSLYPSIIISHNIDPSTIDCECCPEDSYRSPTGHYFCKKKRGLIPETLNELVQRRIEVKKGLKNEKNPERRRFLDVKQQVLALLAASMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 24 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSAYSSIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 25 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSFAGSIIISHNIDPSTIDCECCPEDSYRSPTGHYFCKKKRGLIPETLNELVQRRIEVKKGLKNEKNPERRRFLDVKQQSLKLLANSMYGYFGFPHARWYCLECAESITALGRKYHLHTIDIVPKFGFDVIYGDTDSVYLIKPNITGRERVMKDAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 26 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSAGSSIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYHLHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 27 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSSAGSIIISHNIDPSTIDCECCPEDSYRSPTGHYFCKKKRGLIPETLNELVQRRIEVKKGLKNEKNPERRRFLDVKQQSLKLLANSMYGYFGFPRARWYCRECAESITALGRKYHLHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 28 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSLGGSIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 29 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSSAGSIIISHNIDPSTIDCECCPEDSYRSPTGHYFCKKKRGLIPETLNELVQRRIEVKAGLKNEKNPERRRFLDVKQQALKALANSMYGYFGFPRARWYCRECAESITALGRKYHLHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 30 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSTGASIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYHLHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 31 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSSAGSIIISHNIDPSTIDCECCPEDSYRSPTGHYFCKKKRGLIPETLNELVQRRIEVKKGLKNEKNPERRRFLDVKQQSLKLLANSMYGYFGFPRARWYCLECAESITALGRKYHLHTIDIVPKFGFDVIYGDTDSVYLIKPNITDRERVMKNAEHFLDKINSELPEAMELEFEGFYPRGIFITKKRYALIDERGKSIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 32 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSSAGSIIISHNIDPSTIDCECCPEDSYRSPTGHYFCKKKRGLIPETLNELVQRRIEVKKGLKNEKNPERRRFLDVKQRALKLLANSMYGYFGFPRARWYCRECAESITALGRKYHLHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 33 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSLAASIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 34 - protein, 773 aa, Artificial Sequence
  Description of Artificial Sequence: Synthetic polypeptide
MKKTLLDADYITREEKAVVRLFYKTEEGREIQEVADFRPYLYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSFAGSIIISHNIDPSTIDCECCPEDSYRSPTGHYFCKKKRGLIPETLNELVQRRIEVKKGLKNEKNPERRRFLDVKQQSLKLLANSMYGYFGFPRARWYCLECAESITALGRKYHLHTIDIVPKFGFDVIYGDTDSVYLIKPNITDRERVMKDAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 35 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRVSYPSIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 36 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRSLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSFAGSIIISHNIDPSTIDCECCPEDSYRSPTGHYFCKKKRGLIPETLNELVQRRIEVKKGLKNEKNPERRRFLDVKQQSLKLLANSMYGYFGFPRARWYCLECAESITALGRKYHLHTIDIVPKFGFDVIYGDTDSVYLIKPNITDRERVMKDAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 37 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSAGGSIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYHLHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 38 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSSAGSIIISHNIDPSTIDCECCPEDSYRSPTGHYFCKKKRGLIPETLNELVQRRIEVKKGLKNEKNPERRRFLDVKQQSLKLLANSMYGYFGFPRARWYCRECAESITALGRKYHLHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKGGLEFKQGNIVTYVVTKKGKSISDKARVIDFVEEGDYDPDYYINNQVLPSVLRILEALGYSEDELKGLGKQMKLGGF

SEQ ID NO: 39 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSAAASIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 40 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSLVGSIIISHNIDPSTIDCECCPEDSYRSPTGHYFCKKKRGLIPETLNELVQRRIEVKKGLKNEKNPERRRFLDVKQQALKLLANSMGGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 41 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSSAGSIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 42 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSFAGSIIISHNIDPSTIDCECCPEDSYRSPTGHYFCKKKRGLIPETLNELVQRRIEVKKGLKNEKNPERRRFLDVKQQSLKLLANSMYGYFGFPRARWYCLECAESITALGRKYHLHTIDIVPKFGFDVIYGDTDSVYLIKPNITDRERVMKDAEHFLDKINSELPEAMELEFEGFYPRGIFITKKRYALIDERGKLIVKGLETKRRDWANIAKDTQEKVLGALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 43 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSVYGSIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 44 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRGLSPSIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 45 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSGAPSIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 46 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSLYPSIIISHNIDPSTIDCECCPEDSYRSPTGHYFCKKKRGLIPETLNELVQRRIEVKKGLKNEKNPERRRFLDVKQQVLGLLAASMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 47 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGSKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSSAGSIIISHNIDPSTIDCECCPEDSYRSPTGHYFCKKKRGLIPETLNELVQRRIEVKKGLKNEKNPERRRFLDVKQQSLKLLANSMYGYFGFPRARWYCLECAESITALGRKYHLHTIDIVPKFGFDVIYGDTDSVYLIKPNITDRERVMKDAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 48 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSIAGSIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYFLHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 49 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQVFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSFAGSIIISHNIDPSTIDCECCPEDSYRSPTGHYFCKKKRGLIPETLNELVQRRIEVKKGLKNEKNPERRRFLDVKQQSLKLLANSMYGYFGFPRARWYCLECAESITALGRKYHLHTIDIVPKFGFDVIYGDTDSVYLIKPNITDRERVMKDAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 50 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSVASSIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 51 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLQLHYEISRITRELIYQSSRAGSGQRVESLLIKKAFEKSILVPNRPSDRVVNERQRKTYIGAYVVEPKRGIHDNILLFDFRSSAGSIIISHNIDPSTIDCECCPEDSYRSPTGHYFCKKKRGLIPETLNELVQRRIEVKKGLKNEKNPERRRFLDVKQRALKLLANSMYGYFGFPRARWYCRECAESITALGRKYHLHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 52 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSFAGSIIISHNIDPSTIDCECCPEDSYRSPTGHHFCKKKRGLIPETLNELVQRRIEVKKGLKNEKNPERRRFLDVKQQSLKLLANSMFGYFGSPRARWYCLECAESITALGRKYHLHTIDIVPKFGFDVIYGDTDSVYLIKPNITDRERIVKDAEHFLDKINSNLPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 53 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSFAGSIIISHNIDPSTIDCECCPEDSYRSPTGHYFCKKKRGLIPETLNELVQRRIEVKKGLKNEKNPEHRRFLDVKQQSLKLLANSMYGYFGFPRARWYCLECAESITALGRKYHLHTIDIVPKFGFDVIYGDTDSVYLIKPNITDRERVMKDAEHFLDRINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 54 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSSAGSIIISHNIDPSTIDCECCPEDSYRSPTGHYFCKKKRGLIPETLNELVQRRIEVKKGLKNEKNPERRRFLDVKQQSLKCLANSMYGYFGFPRARWYCRECAESITALGRKYHLHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 55 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSFAGSIIISHNIDPSTIDCECCPEDSYRSPTGHYFCKKKRGLIPETLNELVQRRIEVKKGLKNEKNPERRRFLDVKQQSLKLLANSIYGYFGFPRARWYCLECAESITALGRKYHLHTIDIVPKFGFDVIYGDTDSVYLIKPNITDRERVMKDAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 56 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRGLYASIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 57 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRGLVPSIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 58 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSVASSIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYHLHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 59 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSLGCSIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 60 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSLYPSIIISHNIDPSTIDCECCPEDSYRSPTGHYFCKKKRGLIPETLNELVQRRIEVKKGLKNEKNPERRRFLDVKQQALKLLANSMAGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 61 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSFAGSIIISHNIDPSTIDCECCPEDSYRSPTGHYFCKKKRGLIPETLNELVQCRIEVKKGLKNEKNPERRRFLDVKQQSLKLLANSMYGYFGFPRARWYCLECAESITALGRKYHLHTIDIVPKFGFDVIYGDTDSVYLIKPNITDRERVMKDAEHFLDKINSELPGAMELEFEGFYPRGIFITKKRYALIDERGKLIVKGLEAKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 62 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSSAGSIIISHNIDPSTIDCECCPEDSYRSPTGHYFCKKKRGLIPETLNELVQRRIEVKKGLKNEKNPERRRFLDVKQCSLKRLANSMYGYFGFPRARWYCRECAESITALGRKYHLHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 63 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSSAGSIIISHNIDPSTIDCECCPEDSYRSPTGHYFCKKKRGLIPETLNELVQRRIEVKKGLKNEKNPERRRFLDVKQQSLKHLANSMYGYFGFPRARWYCRECAESITALGRKYHLHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 64 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSSAGSIIISHNIDPSTIDCECCPEDSYRSPTGHYFCKKKRGLIPETLNELVQRRIEVKKGLKNEKNPERRRFLDVKQQSLKLLANSMYGYFGFPRARWYCPECAESITALGRKYHLHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 65 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSFAASIIISHNIDPSTIDCECCPEDSYRSPTGHYFCKKKRGLIPETLNELVQRRIEVKKGLKNEKNPERRRFLDVKQQSLKLLANSMYGYFGFPRARWYCLGCAESITALGRKYHLHTIDIVPKFGFDVIYGDTDSVYLIKPNITDRERVMKDAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 66 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSAASSIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYHLHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 67 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSFAGSIIISHNIDPSTIDCECCPEDSYRSPTGHYFCKKKRGLIPETLNELVQRRIEVKKGLKNEKNPERRRFLDVKQQSLKLLANSMYGYFGFPRARWYCLECAEGITALGRKYHLHTIDIVPKFGFDVIYGDTDSVYLIKPNITDRERVMKDAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 68 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRIIRELIYQSSRAGSGQRVESLLIKKAFEKSILVPNRPSDRVVNERQRKTYIGAYVVEPKRGIHDNILLFDFRSFAGSIIISHNIDPSTIDCECCPEDSYRSPTGHYFCKKKRGLIPETLNELVQRRIEVKKGLKNEKNPERRRFLDVKQQSLKLLANSMYGYFGFPRARWYCLECAESITALGRKYHLHTIDIVPKFGFDVIYGDTDSVYLIKPNITDRERVMKDAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 69 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIPDNILLFDFRSLYPSIIISHNIDPSTIDCECCPEDSYRSPTGHYFCKKKRGLIPETLNELVQRRIEVKKGLKNEKNPERRRFLDVKQQVLGLLAASMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 70 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSVGGSIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYHLHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 71 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSSAGSIIISHNIDPSTIDCECCPEDSYRSPTGHYFCKKKRGLIPETLNELVQRRIEVKKGLKNEKNPERRRFLDVKQQSLKLLANSMYGYFGFPRARWYSLECAESITALGRKYHLHTIDIVPKFGFDVIYGDTDSVYLIKPNITDRERVMKDAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 72 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSLYPSIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYHLHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 73 - protein, 773 aa, Artificial Sequence; identical to SEQ ID NO: 34
  Description of Artificial Sequence: Synthetic polypeptide

SEQ ID NO: 74 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSLASSIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 75 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSVYSSIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 76 - protein, 773 aa, Artificial Sequence
  Description of Artificial Sequence: Synthetic polypeptide
MKKTLLDADFITRKEKAVVRLFYKTEEGREIQEVADFRPYMYVLPEERDLKKLQREIKELKNITNVEIKRMIEGNREVEVLKVMVNQPRDVPNLRGLIKELEGVKEVREAHIPFVERYLIDSGLIPMQDVENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSFAGSIIISHNIDPSTIDCECCPEDSYRSPTGHYFCKKKRGLIPETLNELVQRRIEVKKGLKNEKNPERRRFLDVKQQALKLLANSMYGYFGFPRARWYCLECAESISALGRKYHLHTIDIVPKFGFDVIYGDTDSVYLIKPNITDRERVMKDAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMADYKTEGPHIVAAKKAMKRGLEFKQGDIVTYVVTKKGKSISDKARVIDFVEEGDYDPDYYINNQVLPSVLRILEALGYSEDELKGLGKQMKLGGF

SEQ ID NO: 77 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSLSVSIIISHNIDPSTIDCECCPEDSYRSPTGHYFCKKKRGLIPETLNELVQRRIEVKKGLKNEKNPERRRFLDVKQQALKLLANSMRGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 78 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRVLYVSIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 79 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSSAGSIIISHNIDPSTIDCECCPEDSYRSPTGHYFCKKKRGLIPETLNELVQRRIEVKKGLKNEKNPERRRFLDVKQQSLKLLANSMYGYFGFPRARWYCRECAESITALGRKYHLHTIDIVPKFGFDVIYGDTDSVYLIKPNITDRERVMKNAEHFLDKINSELPEAMELEFEGFYPRGIFITKKRYALIDEKGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 80 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSFAGSIIISHNIDPSTIDCECCPEDSYRSPTGHYFCKKKRGLIPETLNELVQRRIEVKKGLKNEKNPERRRFLDVKQQSLKLLANSIYGYFGFPRARWYCLECAESITALGRKYHLHTIDIVPKFGFDVIYGDTDSVYLIKPNITDRERVMKDAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIAAAKKAMKRGLEFKQGNIVTYVVTKKGKSISDKARVIDFVEEGDYDPDYYINNQVLPSVLRILEALGYSEDELKGLGKQMKLGGF

SEQ ID NO: 81 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNVTNVEIKRMIEGDRGVEVLKVMVNHPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSFAGSIIISHNIDPSTIDCECCPEDSYRSPTGHYFCKKKRGLIPETLNELVQRRIEVKKGLKNEKNPERRRFLDVKQQSLKLLANSMYGYFGFPRARWYCLECAESITALGRKYHLHTIDIVPKFGFDVIYGDTDSVYLIKPNITDRERVMKDAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 82 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFSSLYPSIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 83 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSLYPSIIISHNIDPSTIDCECCPEDSYRSPTGHYFCKKKRGLIPETLNELVQRRIEVKKGLKNEKNPERRRFLDVKQQVLQLLAGSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 84 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSLYPSIIISHNIDPSTIDCECCPEDSYRSPTGHYFCKKKRGLIPETLNELVQRRIEVKKGLKNEKNPERRRFLDVKQQVLVLLAASMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 85 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSFAGSIIISHNIDPSTIDCECCPEDSYRSPTGHYFCKKKRGLIPETLNELVQRRIEVKKGLKNEKNPERRRFLDVKQQSLKLLANSMYGYFGFPRARWYCLECAESITALGRKYHLHTIDIVPKFGFDVIYGDTDSVYLIKPNITDRERVMKDAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 86 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSSAGSIIISHNIDPSTIDCECCPEDSYRSPTGHYFCKKKRGLIPETLNELVQRRIEVKKGLKNEKNPERRRFLDVKQQSLKLLANSMYGYFGFPRARWYCRECAESITALGRKYHLHTIDIVPKFGFDVIYGDTDSVYLIKPNITDRERVMKNAEHFLDKINSELPEAMELEFEGFYPRGIFITKKRYALIDERGELIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 87 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSLYPSIIISHNIDPSTIDCECCPEDSYRSPTGHYFCKKKRGLIPETLNELVQRRIEVKKGLKNEKNPERRRFLDVKQQVLSLLAVSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 88 - protein, 773 aa, Artificial Sequence
  Description of Artificial Sequence: Synthetic polypeptide
MKKTLLDADYITRGEKAVVRLFYKTEEGREIQEVADFRPYMYVLPEEHDLKKLQREIKELKNITNVEVKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSFAGSIIISHNIDPSTIDCECCPEDSYRSPTGHYFCKKKRGLIPETLNELVQRRIEVKKGLKNEKNPERRRFLDVKQQSLKLLANSMYGYFGFPRARWYCLECAESITALGRKYHLHTIDIVPKFGFDVIYGDTDSVYLIKPNITDRERVMKDAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 89 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSMAGSIIISHNIDPSTIDCECCPEDSYRSPTGHYFCKKKRGLIPETLNELVQRRIEVKKGLKNEKNPERRRFLDVKQQSLKLLANSMYGYFGFPRARWYCLECAESITALGRKYHLHTIDIVPKFGFDVIYGDTDSVYLIKPNITDRERVMKDAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 90 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRGVYPSIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 91 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVRNLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSSAGSIIISHNIDPSTIDCECCPEDSYRSPTGHYFCKKKRGLIPETLNELVQRRIEVKKGLKNEKNPERRRFLDVKQQSLKLLANSMYGYFGFPRARWYCLECAESITALGRKYHLHTIDIVPKFGFDVIYGDTDSVYLIKPNITDRERVMKDAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 92 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSSAGSIIISHNIDPSTIDCECCPEDSYRSPTGHYFCKKKRGLIPETLNELVQRRIEVKKGLKNEKNPERRRFLDVKQGSLKLLANSMYGYFGFPRARWYCRECAESITALGRKYHLHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 93 - protein, 773 aa, Artificial Sequence; identical to SEQ ID NO: 17
  Description of Artificial Sequence: Synthetic polypeptide

SEQ ID NO: 94 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSLGVSIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 95 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSFAGSIIISHNIDPSTIDCECCPEDSYRSPTGHYFCKKKRGLIPETLNELVQRRIEVKKGLKNEKIPERRRFLDVKQQSLKLLANSMYGYFGFPRARWYCLECAESITALGRKYHLHTIDIVPKFGFDVIYGDTDSVYLIKPNITDRERVMKDAEHFLDKINSELPEAMELEFEGFYPRGIFITKKRYALIDERGKLIVKGLEAKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 96 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSLGASIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 97 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSSAGSIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYHLHTIDIVPKFGFDVIYGDTDSVYLIKPNITDRERVMKNAEHFLDKINSELPEAMELEFEGFYPRGIFITKKRYALIDEKGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 98 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRVLSPSIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 99 - protein, 773 aa, Artificial Sequence
  Description of Artificial Sequence: Synthetic polypeptide
MKKTLLDADYITREEKAVVRLFYKTEEGREIQEVADFRPYMYVLSEEHDLKKLQREIRELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSFAGSIIISHNIDPSTIDCECCPEDSYRSPTGHYFCKKKRGLIPETLNELVQRRIEVKKGLKNEKNPERRRFLDVKQQSLKLLANSMYGYFGFPRARWYCLECAESITALGRKYHLHTIDIVPKFGFDVIYGDTDSVYLIKPNITDRERVMKDAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 100 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVSRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSSAGSIIISHNIDPSTIDCECCPEDSYRSPTGHYFCKKKRGLIPETLNELVQRRIEVKKGLKNEKNPERRRFLDVKQQSLKLLANSMYGYFGFPRARWYCLECAESITALGRKYHLHTIDIVPKFGFDVIYGDTDSVYLIKPNITDRERVMKDAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 101 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSFAGSIIISHNIDPSTIDCECCPEDSYRSPTGHYFCKKKRGLIPETLNELVQRRIEVKKGLKNEKNPERRRFLDVKQQSLKLLGNSMYGYFGFPRARWYCLECAESITALGRKYHLHTIDIVPKFGFDVIYGDTDSVYLIKPNITDRERVMKDAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 102 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSFAGSIIISHNIDPSTIDCECCPEDSYRSPTGHYFCKKKRGLIPETLNELVQRRIEVKKGLKNEKNPERRRFLDVKQQSLKLLANSMYGYFGFPRARWYCLECAESITALGRKYHLHTIDIVPKFGFDVIYGDTDSVYLIKPNITDRERVMKDAEHFLNKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 103 - protein, 773 aa, Artificial Sequence; identical to SEQ ID NO: 18
  Description of Artificial Sequence: Synthetic polypeptide

SEQ ID NO: 104 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSLYPSIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYGLHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 105 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSSAGSIIISHNIDPSTIDCECCPEDSYRSPTGHYFCKKKRGLIPETLNELVQRRIEVKKGLKNEKNPERRRFLDVKQTSLKSLANSMYGYFGFPRARWYCRECAESITALGRKYHLHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 106 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSLGSSIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 107 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIRKREIDIIVTYNGDNFDFPYLEERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSFAGSIIISHNIDPSTIDCECCPEDSYRSPTGHYFCKKKRGLIPETLNELVQRRIEVKKGLKNEKNPERRRFLDVKQQSLKLLANSMYGYFGFPRARWYCLECAESITALGRKYHLHTIDIVPKFGFDVIYGDTDSVYLIKPNITDRERVMKDAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 108 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRGSYPSIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 109 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSFAGSIIISHNIDPSTIDCECCPEDSYRSPTGHYFCKKKRGLIPETLNELVQRRIEVKKGLKNEKNPERRRFLDVKQQSLKLLANSIYGYFGFPRARWYCLECAESITALGRKYHLHTIDIVPKFGFDVIYGDTDSVYLIKPNITDRERVMKDAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKSLGKQMKLGGF

SEQ ID NO: 110 - protein, 773 aa, Artificial Sequence; identical to SEQ ID NO: 72
  Description of Artificial Sequence: Synthetic polypeptide

SEQ ID NO: 111 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSLSASIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 112 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSLYPSIIISHNIDPSTIDCECCPEDSYRSPTGHYFCKKKRGLIPETLNELVQRRIEVKKGLKNEKNPERRRFLDVKQQALKLLANSMQGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 113 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSSAGSIIISHNIDPSTIDCECCPEDSYRSPTGHYFCKKKRGLIPETLNELVQRRIEVKKGLKNEKNPERRRFLDIKQRALKLLANSMYGYFGFPRARWYCRECAESITALGRKYHLHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 114 - protein, 767 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGVKEVREAHIPFAERYLIDSGLIPMQDVENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVVRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSFAGSIIISHNIDPSTIDCECCPEDSYRSPTGHYFCKKKRGLIPETLNELVQRRIEVKKGLKNEKNPERRRFLDVKQQSLKLLANSMYGYFGFPRARWYCLECAESITALGRKYHLHTIDIVPKFGFDVIYGDTDSVYLIKPNITDRERVMKDAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQ

SEQ ID NO: 115 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSVVASIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 116 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSLGASIIISHNIDPSTIDCECCPEDSYRSPTGHYFCKKKRGLIPETLNELVQRRIEVKKGLKNEKNPERRRFLDVKQQALKLLANSMNGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 117 - protein, 773 aa, Artificial Sequence
  Description of Artificial Sequence: Synthetic polypeptide
MKKTLLDADYITRKEKAVVRLFYKTEEGREIQEVADFRPYMYVLPEERDLKKLQREIKELKNITNVEIKRMIEGNREVEVLKVMVNQPRDVPNLRGLIKELEGVKEVREAHIPFVERYLIDSGLIPMQDVENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVVRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAIEKSILVPNRPSDRVVSERQRKTYIGAYVVEPKRGIHDNILLFDFRSSAGSIIISHNIDPSTIDCECCPEDSYRSPTGHYFCKKKRGLIPETLNELVQRRIEVKKGLKNEKNPERRRFLDVKQQSLKLLANSIYGYFGFPRARWYCLECAESITALGRKYHLHTIDIVPKFGFDVIYGDTDSVYLIKPNITDRERVMKDAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGDIVTYVVTKKGKSISDKARVIDFVEEGDYDPDYYINNQVLPSVLRILEALGYSEDELKGLGKQMKLGGF

SEQ ID NO: 118 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSFAGSIIISHNIDPSTIDCECCPEDSYRSPTGHYFCKKKRGLIPETLNELVQRRIEVKKGLKNEKNPERRRFLDVKQQSLKLLANGMYGYFGFPRARWYCLECAESITALGRKYHLHTIDIVPKFGFDVIYGDTDSVYLIKPNITDRERVMKDAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 119 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSSAGSIIISHNIDPSTIDCECCPEDSYRSPTGHYFCKKKRGLIPETLNELVQRRIEVKKGLKNEKNPERRRFLDVKQRSLKLLANSMYGYFGFPRARWYCRECAESITALGRKYHLHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 120 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSLYPSIIISHNIDPSTIDCECCPEDSYRSPTGHYFCKKKRGLIPETLNELVQRRIEVKKGLKNEKNPERRRFLDVKQQVLSLLAGSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 121 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSSAGSIIISHNIDPSTIDCECCPEDSYRSPTGHYFCKKKRGLIPETLNELVQRRIEVKAGLKNEKNPERRRFLDVKQQALKLLANSMYGYFGFPRARWYCRECAESITALGRKYHLHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 122 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSVTISIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 123 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSSAGSIIISHNIDPSTIDCECCPEDSYRSPTGHYFSKKKRGLIPETLNELVQRRIEVKKGLKNEKNPERRRFLDVKQQSLKLLANSMYGYFGFPRARWYCLECAESITALGRKYHLHTIDIVPKFGFDVIYGDTDSVYLIKPNITDRERVMKDAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 124 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFVERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSFAGSIIISHNIDPSTIDCECCPEDSYRSPTGHYFCKKKRGLIPETLNELVQRRIEVKKGLKNEKNPERRRFLDVKQQSLKLLANSMYGYFGFPRARWYCLECAESITALGRKYHLHTIDIVPKFGFDVIYGDTDSVYLIKPNITDRERVMKDAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 125 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRVLYSSIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 126 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGIDGSPLRLERRGMNLGAHVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSFAGSIIISHNIDPSTIDCECCPEDSYRSPTGHYFCKKKRGLIPETLNELVQRRIEVKKGLKNEKNPERRRFLDVKQQSLKLLANSMYGYFGFPRARWYCLECAESITALGRKYHLHTIDIVPKFGFDVIYGDTDSVYLIKPNITDRERVMKDAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 127 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRASYPSIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 128 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSIAASIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYLLHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 129 - protein, 773 aa, Artificial Sequence
  Description of Artificial Sequence: Synthetic polypeptide
MKKTLLDADFITRKEKAVVRLFYKTEEGREIQEVADFRPYMYVLPEERDLKKLQREIKELKNITNVEIKRMIEGNREVEVLKVMVNQPRDVPNLRGLIKELEGVKEVREAHIPFVERYLIDSGLIPMQDVENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSFAGSIIISHNIDPSTIDCECCPEDSYRSPTGHYFCKKKRGLIPETLNELVQRRIEVKKGLKNEKNPERRRFLDVKQQALKLLANSMYGYFGFPRARWYCLECAESITALGRKYHLHTIDIVPKFGFDVIYGDTDSVYLIKPNITDRERVMKDAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMADYKTEGPHIVAAKKAMKRGLEFKQGDIVTYVVTKKGKSISDKARVIDFVEEGDYDPDYYINNQVLPSVLRILEALGYSEDELKGLGKQMKLGGF

SEQ ID NO: 130 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSAAASIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYHLHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 131 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSSAGSIIISHNIDPSTIDCECCPEDSYRSPTGHYFCKKKRGLIPETLNELVQRRIEVKAGLKNEKNPERRRFLDVKQRALKLLANSMYGYFGFPRARWYCRECAESITALGRKYHLHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 132 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRASSGQRVESLLIKKAFEKSILVPNRPSDRVVNERQRKTYIGAYVVEPKRGIHDNILLFDFRSSAGSIIISHNIDPSTIDCECCPEDNYRSPTGHYFCKKKRGLIPETLNELVQRRIEVKKGLKNEKNPERRRFLDVKQQSLKLLANSMYGYFGFPRARWYCLECAESITALGRKYHLHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 133 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSVAASIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 134 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSLYPSIIISHNIDPSTIDCECCPEDSYRSPTGHYFCKKKRGLIPETLNELVQRRIEVKKGLKNEKNPERRRFLDVKQQVLVLLAGSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 135 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSSAGSIIISHNIDPSTIDCECCPEDSYRSPTGHYFCKKKRGLIPETLNELVQRRIEVKKGLKNEKNPERRRFLDVKQQSLKRLANSMYGYFGFPRARWYCRECAESITALGRKYHLHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 136 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSSAGSIIISHNIDPSTIDCECCPEDSYRSPTGHYFCKKKRGLIPETLNELVQRRIEVKKGLKNEKNPERRRFLDVKQQSLKLLANSMYGYFGFPRARWYCLECAESITALGRKYHLHTIDIVPKFGFDVIYGDTDSVYLIKPNITDRERVMKDAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVERGDYDPDYYINNQVLPSVLRILEALGYSEDELKGLGKQMKLGGF

SEQ ID NO: 137 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSSAGSIIISHNIDPSTIDCECCPEDSYRSPTGHYFCKKKRGLIPETLNELVQRRIEVKKGLKNEKNPERRRFLDVKQQSLKLLANSMYGYFGFPRARWYCRECAESITALGRKYHLHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDGLKGLGKQMKLGGF

SEQ ID NO: 138 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSVAGSIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYTLHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 139 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSIAASIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 140 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSSGGSIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYHLHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 141 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSLVASIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 142 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRALGPSIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 143 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSVTSSIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYHLHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 144 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRGLYGSIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 145 - protein, 773 aa, Artificial Sequence
  Description of Artificial Sequence: Synthetic polypeptide
MKKTLLDANYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSFAGSIIISHNIDPSTIDCECCPEDSYRSPTGHYFCKKKRGLIPETLNELVQRRIEVKKGLKNEKNPERRRFLDVKQQSLKLLANSMYGYFGFPRARWYCLECAESITALGRKYHLHTIDIVPKFGFDVIYGDTDSVYLIKPNITDRERVMKDAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 146 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSLYPSIIISHNIDPSTIDCECCPEDSYRSPTGHYFCKKKRGLIPETLNELVQRRIEVKKGLKNEKNPERRRFLDVKQQVLGLLASSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 147 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSSAGSIIISHNIDPSTIDCECCPEDSYRSPTGHYFCKKKRGLIPETLNELVQRRIEVKKGLKNEKNPERRRFLDVKQQSLKILANSMYGYFGFPRARWYCRECAESITALGRKYHLHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 148 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRVLAPSIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 149 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSSYGSIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 150 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSSYPSIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 151 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSSAGSIIISHNIDPSTIDCECCPEDSYRSPTGHYFCKKKRGLIPETLNELVQRRIEVKKGLKNEKNPERRRFLDVKQQSLKYLANSMYGYFGFPRARWYCRECAESITALGRKYHLHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 152 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAGRYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSFAGSIIISHNIDPSTIDCECCPEDSYRSPTGHYFCKKKRGLIPETLNELVQRRIEVKKGLKNEKNPERRRFLDVKQQSLKLLANSMYGYFGFPRARWYCLECAESITALGRKYHLHTIDIVPKFGFDVIYGDTDSVYLIKPNITDRERVMKDAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 153 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRGAYPSIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 154 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSVAGSIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYSLHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 155 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSLYPSIIISHNIDPSTIDCECCPEDSYRSPTGHYFCKKKRGLIPETLNELVQRRIEVKKGLKNEKNPERRRFLDVKQQALKLLANSMSGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 156 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSLSSSIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 157 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRVLAPSIIISHNIDPSTIDCECCPEDSYRSPTGHYFCKKKRGLIPETLNELVQRRIEVKKGLKNEKNPERRRFLDVKQQVLGLLASSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 158 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSAYASIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 159 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSLYPSIIISHNIDPSTIDCECCPEDSYRSPTGHYFCKKKRGLIPETLNELVQRRIEVKKGLKNEKNPERRRFLDVKQQVLSLLAGSMYGYFGSPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 160 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSSAGSIIISHNIDPSTIDCECCPEDSYRSPTGHYFCKKKRGLIPETLNELVQRRIEVKKGLKNEKNPERRRFLDVKQQSLKLLANSMYGYFGFPRARWYCYECAESITALGRKYHLHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 161 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPRKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSSAGSIIISHNIDPSTIDCECCPEDSYRSPTGHYFCKKKRGLIPETLNELVQRRIEVKKGLKNEKNPERRRFLDVKQQSLKLLANSMYGYFGFPRARWYCLECAESITALGRKYHLHTIDIVPKFGFDVIYGDTDSVYLIKPNITDRERVMKDAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 162 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSSAGSIIISHNIDPSTIDCECCPEDSYRSPTGHYFCKKKRGLIPETLNELVQRRIEVKKGLKNEKNPERRRFLDVKQQSLKSLANSMYGYFGFPRARWYCRECAESITALGRKYHLHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 163 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSFAGSIIISHNIDPSTIDCECCPEDSYRSPTGHYFCKKKRGLIPETLNELVQRRIEVKKGLKNEKNPERRRFLDVKQQSLKLLANSMYGYFGFPRARWYCLECAESITALGRKYHLHTIDIVPKFGFDVIYGDTDSVYLIKPNITDRERVMKDVEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 164 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSSAGSIIISHNIDPSTIDCECCPEDSYRSPTGHYFCKKKRGLIPETLNELVQRRIEVKKGLKNEKNPERRRFLDVKQQSLKLLANSMYGYFGFPRARWYCLECAESITALGRKYHLHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 165 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSLYPSIIISHNIDPSTIDCECCPEDSYRSPTGHYFCKKKRGLIPETLNELVQRGIEVKKGLKNEKNPERRRFLDVKQQALKLLANSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 166 - protein, 773 aa, Artificial Sequence
  Description of Artificial Sequence: Synthetic polypeptide
MKKTLLDADYITREEKAVVRLFYKTEEGREIQEVADFRPYMYVLPEERDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSFAGSIIISHNIDPSTIDCECCPEDSYRSPTGHYFCKKKRGLIPETLNELVQRRIEVKKGLKNEKNPERRRFLDVKQQSLKLLANSMYGYFGFPRARWYCLECAESITALGRKYHLHTIDIVPKFGFDVIYGDTDSVYLIKPNITDRERVMKDAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 167 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRGLYPSIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 168 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSSAGSIIISHNIDPSTIDCECCPEDSYRSPTGHYFCKKKRGLIPETLNELVQRRIEVKKGLKNEKNPERRRFLDVKQGSLKILANSMYGYFGFPRARWYCRECAESITALGRKYHLHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 169 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSSTGSIIISHNIDPSTIDCECCPEDSYRSPTGHYFCKKKRGLIPETLNELVQRRIEVKKGLKNEKNPERRRFLDVKQQSLKLLANSMYGYFGFPRARWYCLECAESITALGRKYHLHTIDIVPKFGFDVIYGDTDSVYLIKPNITDRERVMKDAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 170 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSLTKSIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 171 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSSAGSIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYHLHTIDIVPKFGFDVIYGDTDSVYLIKPNITDRERVMKNAEHFLDKINSELPEAMELEFEGFYPRGIFITKKRYALIDERGKLIVKGLETKRRTWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 172 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSSAGSIIISHNIDPSTIDCECCPEDSYRSPTGHYFCKKKRGLIPETLNELVQRRIEVKKGLKNEKNPERRRFLDVKQQSLKGLANSMYGYFGFPRARWYCRECAESITALGRKYHLHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 173 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSVGGSIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 174 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVLVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSFAGSIIISHNIDPSTIDCECCPEDSYRSPTGHYFCKKKRGLIPETLNELVQRRIEVKKGLKNEKNPERRRFLDVKQQSLKLLANSMYGYFGFPRARWYCLECAESITALGRKYHLHTIDIVPKFGFDVIYGDTDSVYLIKPNITDRERVMKDAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 175 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSVGASIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYHLHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 176 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSLSGSIIISHNIDPSTIDCECCPEDSYRSPTGHYFCKKKRGLIPETLNELVQRRIEVKKGLKNEKNPERRRFLDVKQQALKLLANSMSGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 177 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSTAASIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 178 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSISSSIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 179 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKGEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSFAGSIIISHNIDPSTIDCECCPEDSYRSPTGHYFCKKKRGLIPETLNELVQRRIEVKKGLKNEKNPERRRFLDVKQQSLKLLANSMYGYFGFPRARWYCLECAESITALGRKYHLHTIDIVPKFGFDVIYGDTDSVYLIKPNITDRERVMKDAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 180 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGRRKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSSAGSIIISHNIDPSTIDCECCPEDSYRSPTGHYFCKKKRGLIPETLNELVQRRIEVKKGLKNEKNPERRRFLDVKQQSLKLLANSMYGYFGFPRARWYCLECAESITALGRKYHLHTIDIVPKFGFDVIYGDTDSVYLIKPNITDRERVMKDAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 181 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSSAGSIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYHLHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTIITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 182 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLLREIKELKNITNVEIKRMIEGDREVEVLKVMVNQPRDVPNLRGLIKELEGCKEVREAHIPFAERYLIDSGLISMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSFAGSIIISHNIDPSTIDCECCPEDSYRSPTGHYFCKKKRGLIPETLNELVQRRIEVKKGLKNEKNPERRRFLDVKQQSLKLLANSMYGYFGFPRARWYCLECAESITALGRKYHLHTIDIVPKFGFDVIYGDTDSVYLIKPNITDRERVMKDAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 183 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSFAGSIIISHNIDPSTIDCECCPEDSYRSPTGHYFCKKKRGLIPETLNELVQRRIEVKKDLKNEKNPERRRFLDVKQQSLKLLANSMYGYFGFPRARWYCLECAESITALGRKYHLHTIDIVPKFGFDVIYGDTDSVYLIKPNITDRERVMKDAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 184 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSSAGSIIISHNIDPSTIDCECCPEDSYRSPTGHYFCKKKRGLIPETLNELVQRRIEVKKGLKNEKNPERRRFLDVKQQSVKNLANSMYGYFGFPRARWYCRECAESITALGRKYHLHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 185 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSLYPSIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYSLHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 186 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSFAGSIIISHNIDPSTIDCECCPEDSYRSPTGHYFCKKKRGLIPETLNELVQRRIEVKKGLKNEKNPERRRFLDVKQQSLKLLANSMYGYFGFPRARWYCLECAESITALGRKYHLHTIDIVPKYGFDVIYGDTDSVYLIKPNITDRERVMKDAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 187 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSLYPSIIISHNIDPSTIDCECCPEDSYRSPTGHYFCKKKRGLIPETLNELVQRRIEVKKGLKNEKNPERRRFLDVKQQVLGLLAVSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 188 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSSAGSIIISHNIDPSTIDCRCCPEDSYRSPTGHYFCKKKRGLIPETLNELVQRRIEVKKGLKNEKNPERRRFLDVKQQSLKLLANSMYGYFGFPRARWYCLECAESITALGRKYHLHTIDIVPKFGFDVIYGDTDSVYLIKPNITDRERVMKDAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 189 - protein, 767 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSFAGSIIISHNIDPSTIDCECCPEDSYRSPTGHYFCKKKRGLIPETLNELVQRRIEVKKGLKNEKNPERRRFLDVKQQSLKLLANSMYGYFGFPRARWYCLECAESITALGRKYHLHTIDIVPKFGFDVIYGDTDSVYLIKPNITDRERVMKDAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELRVWASK

SEQ ID NO: 190 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSGYASIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 191 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSIASSIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 192 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSSAGSIIISHNIDPSTIDCECCPEDSYRNPTGHYFCKKKRGLIPETLNELVQRRIEVKKGLKNEKNPERRRFLDVKQFSLKLLANSMYGYFGFPRARWYCRECAESITALGRKYHLHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 193 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSAYPSIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 194 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIMELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSSAGSIIISHNIDPSTIDCECCPEDSYRSPTGHYFCKKKRGLIPETLNELVQRRIEVKKGLKNEKNPERRRFLDVKQQSLKLLANSMYGYFGFPRARWYCRECAESITALGRKYHLHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 195 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSSAGSIIISHNIDPSTIDCECCPEDSYRSPTGHYFCKKKRGLIPETLNELVQRRIEVKKGLKNEKNPERRRFLDVKQQALKALANSMYGYFGFPRARWYCRECAESITALGRKYHLHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 196 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSSAGSIIISHNIDPSTIDCECCPEDSYRSPTGHYFCKKKRGLIPETLNELVQRRIEVKKGLKNEKNPERRRFLDIKQQALKLLANSMYGYFGFPRARWYCRECAESITALGRKYHLHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 197 - protein, 773 aa, Artificial Sequence; identical to SEQ ID NO: 18
  Description of Artificial Sequence: Synthetic polypeptide

SEQ ID NO: 198 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSAAISIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 199 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSSAGSIIISHNIDPSTIDCECCPEDSYRSPTGHYFCKKKRGLIPETLNELVQRRIEVKKGLKNEKNPERRRFLDVKQQSLKLLANSMYGYFGFPRARWYCRECAESITALGRKYHLHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKGVIRNIKTGKIPLKDLDINTQITRGMAEYKTEGPHIVAAKKAMKRGLEFKQGNIVTYVVTKKGKGISDKARVIDFVEEGDYDPDYYINNQVLPSVLRVLEALGYSEDELKGLGKQMKLGGF

SEQ ID NO: 200 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSVGSSIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYHLHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 201 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSSAGSIIISHNIDPSTIDCECCPEDSYRSPTGHYFCKKKRGLIPETLNELVQRRIEVKKGLKNEKNPERRRFLDVKQQSLKLLANSMYGYFGFPRARWYCFECAESITALGRKYHLHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 202 - protein, 773 aa, Artificial Sequence
  Description of Artificial Sequence: Synthetic polypeptide
MKKTLLDADYITREEKAVVRLFYKTEEGREIQEVADFRPYMYVLPEEHDLRKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSFAGSIIISHNIDPSTIDCECCPEDSYRSPTGHYFCKKKRGLIPETLNELVQRRIEVKKGLKNEKNPERRRFLDVKQQSLKLLANSMYGYFGFPRARWYCLECAESITALGRKYHLHTIDIVPKFGFDVIYGDTDSVYLIKPNITDRERVMKDAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 203 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSLYPSIIISHNIDPSTIDCECCPEDSYRSPTGHYFCKKKRGLIPETLNELVQRRIEVKKGLKNEKNPERRRFLDVKQQVLGLLAGSIYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 204 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSLYPSIIISHNIDPSTIDCECCPEDSYRSPTGHYFCKKKRGLIPETLNELVQRRIEVKKGLKNEKNPERRRFLDVKQQALKLLANSMPGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 205 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSSAGSIIISHNIDPSTIDCECCPEDSYRSPTGHYFCKKKRGLIPETLNELVQRRIEVKKGLKNEKNPERRRFLDVKQQSLKLLANSMYGYFGFPRARWYCRECAESITALGRKYHLHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIMKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 206 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSLVSSIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 207 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSYAGSIIISHNIDPSTIDCECCPEDSYRSPTGHYFCKKKRGLIPETLNELVQRRIEVKKGLKNEKNPERRRFLDVKQQSLKLLANSMYGYFGFPRARWYCLECAESITALGRKYHLHTIDIVPKFGFDVIYGDTDSVYLIKPNITDRERVMKDAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 208 - protein, 773 aa, Artificial Sequence
  Description of Artificial Sequence: Synthetic polypeptide
MKKTLLDADFITRKEKAVVRLFYKTEEGREIQEVADFRPYMYVLPEERDLKKLQREIKELKNITNVEIKRMIEGNREVEVLKVMVNQPRDVPNLRGLIKELEGVKEVREAHIPFVERYLIDSGLIPMQDVENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSYAPSIIISHNIDPSTIDCECCPEDSYRSPTGHYFCKKKRGLIPETLNELVQRRIEVKKGLKNEKNPERRRFLDVKQQALKLLANSMYGYFGFPRARWYCLECAESISALGRKYHLHTIDIVPKFGFDVIYGDTDSVYLIKPNITDRERVMKDAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMADYKTEGPHIVAAKKAMKRGLEFKQGDIVTYVVTKKGKSISDKARVIDFVEEGDYDPDYYINNQVLPSVLRILEALGYSEDELKGLGKQMKLGGF

SEQ ID NO: 209 - protein, 773 aa, Artificial Sequence
  Description of Artificial Sequence: Synthetic polypeptide
MKKTLLDADYITREEKAVVRLFYKTEEGREIQEVADFRPYLYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSFAGSIIISHNIDPSTIDCECCPEDSYRSPTGHYFCKKKRGLIPETLNELVQRRIEVKKGLKNEKNPERRRFLDVKQQSLKLLANSIYGYFGFPRARWYCLECAESITALGRKYHLHTIDIVPKFGFDVIYGDTDSVYLIKPNITDRERVMKDAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 210 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSFAGSIIISHNIDPSTIDCECCPEDSYRSPTGHYFCKKKRGLIPETLNELVQRRIEVKKGLKNEKNPERRRFLDVKQQSLKLLANSMYGYFGFPHARWYCLECAENITALGRKYHLHTIDIVPKFGFDVIYGDTDSVYLIKPNITDRERVMKDAEHFLDKINSELPEAKELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 211 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSGYGSIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 212 - protein, 773 aa, Artificial Sequence; identical to SEQ ID NO: 55
  Description of Artificial Sequence: Synthetic polypeptide

SEQ ID NO: 213 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSYRVVNERQRKTYIGAYVVEPKRGIHDNILLFDFRSSAGSIIISHNIDPSTIDCECCPEDSYRSPTGHYFCKKKRGLIPETLNELVQRRIEVKKGLKNEKNPERRRFLDVKQQSLKLLANSMYGYFGFPRARWYCRECAESITALGRKYHLHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 214 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGNREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSFAGSIIISHNIDPSTIDCECCPEDSYRSPTGHYFCKKKRGLIPETLNELVQRRIEVKKGLKNEKNPERRRFLDVKQQSLKLLANSMYGYFGFPRARWYCLECAESITALGRKYHLHTIDIVPKFGFDVIYGDTDSVYLIKPNITDRERVMKDAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 215 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSSAGSIIISHNIDPSTIDCECCPEDSYRSPTGHYFCKKKRGLIPETLNELVQRRIEVKKGLKNEKNPERRRFLDIKQQSLKLLANSMYGYFGFPRARWYCRECAESITALGRKYHLHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 216 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSLVVSIIISHNIDPSTIDCECCPEDSYRSPTGHYFCKKKRGLIPETLNELVQRRIEVKKGLKNEKNPERRRFLDVKQQALKLLANSMSGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 217 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSLYPSIIISHNIDPSTIDCECCPEDSYRSPTGHYFCKKKRGLIPETLNELVQRHIEVKKGLKNEKNPERRRFLDVKQQALKLLANSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 218 - protein, 773 aa, Artificial Sequence; identical to SEQ ID NO: 152
  Description of Artificial Sequence: Synthetic polypeptide

SEQ ID NO: 219 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSAAVSIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 220 - protein, 773 aa, Artificial Sequence
  Description of Artificial Sequence: Synthetic polypeptide
MKKTLLDADYITREEKAVVRLFYKTERGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSSAGSIIISHNIDPSTIDCECCPEDSYRSPTGHYFCKKKRGLIPETLNELVQRRIEVKKGLKNEKNPERRRFLDVKQQSLKLLANSMYGYFGFPRARWYCLECAESITALGRKYHLHTIDIVPKFGFDVIYGDTDSVYLIKPNITDRERVMKDAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 221 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSSAGSIIISHNIDPSTIDCECCPEDSYRSPTGHYFCKKKRGLIPETLNELVQRRIEVKKGLKNEKNPERRRFLDVKQQSLKALANSMYGYFGFPRARWYCRECAESITALGRKYHLHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 222 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSSAGSIIISHNIDPSTIDCECCPEDSYRSPTGHYFCKKKRGLIPETLNELVQRRIEVKKGLKNEKNPERRRFLDVKQLSLKMLANSMYGYFGFPRARWYCRECAESITALGRKYHLHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 223 - protein, 773 aa, Artificial Sequence; identical to SEQ ID NO: 120
  Description of Artificial Sequence: Synthetic polypeptide

SEQ ID NO: 224 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDSENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSSAGSIIISHNIDPSTIDCECCPEDSYRSPTGHYFCKKKRGLIPETLNELVQRRIEVKKGLKNEKNPERRRFLDVKQQSLKLLANSMYGYFGFPRARWYCLECAESITALGRKYHLHTIDIVPKFGFDVIYGDTDSVYLIKPNITDRERVMKDAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 225 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSSAGSIIISHNIDPSTIDCECCPEDSYRSPTGHYFCKKKRGLIPETLNELVQRRIEVKKGLKNEKNPERRRFLDVKQQSLKLLANSMYGYFGFPRARWYCLECAESITALGRKYHLHTIDIVPKFGFDVIYGDTDSVYLIKPNITDRERVMKDAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 226 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSLVASIIISHNIDPSTIDCECCPEDSYRSPTGHYFCKKKRGLIPETLNELVQRRIEVKKGLKNEKNPERRRFLDVKQQALKLLANSMRGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 227 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSSAGSIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYFLHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 228 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSSAGSIIISHNIDPSTIDCECCPEDSYRSPTGHYFCKKKRGLIPETLNELVQRRIEVKKGLKNEKNPERRRFLDVKQQALKLLANSMYGYFGFPRARWYCLECAESITALGRKYHLHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 229 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSLYPSIIISHNIDPSTIDCECCPEDSYRSPTGHYFCKKKRGLIPETLNELVQRVIEVKKGLKNEKNPERRRFLDVKQQALKLLANSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 230 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSSAGSIIISHNIDPSTIDCECCPEDSYRSPTGHYFCKKKRGLIPETLNELVQRRIEVKKGLKNEKNPERRRFLDVKQQSLKLLANSMYGYFGFPRARWYCRECAESITALGRKYHLHTIDIVPKFGFDVIYGDTDSVYLIKPNITDRERVMKNAEHFLDKINSELPEAMELEFEGFYPRGIFITKKRYALIDERGKLIVKGLETKRRTWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 231 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRALAPSIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 232 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSLYPSIIISHNIDPSTIDCECCPEDSYRSPTGHYFCKKKRGLIPETLNELVQRRIEVKKGLKNEKNPERRRFLDVKQQVLVLLASSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 233 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSIASSIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYHLHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 234 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPRKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSFAGSIIISHNIDPSTIDCECCPEDSYRSPTGHYFCKKKRGLIPETLNELVQRRIEVKKGLKNEKNPERRRFLDVKQQSLKLLANSMYGYFGFPRARWYCLECAESITALGRKYHLHTIDIVPKFGFDVIYGDTDSVYLIKPNITDRERVMKDAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 235 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSFAGSIIISHNIDPSTIDCECCPEDSYRSPTGHYFCKKKRGLIPETLNELVQRRIEVKKGLKNEKNPERRRFLDVKQQSLKLLANSIYGYFGFPRARWYCLECAESITALGRKYHLHTIDIVPKFGFDVIYGDTDSVYLIKPNITDRERVMKDAEHFLDKINSELPEAMELEFEGFYPRGIFITKKRYALIDERGKLIVKGLETKRRDWANIAKDTQEKVLDALLKDKNPEKAASIVKDVIRDIKTGKIPLKDLAINTQITRGMAEYKTEGPHIVAAKKAMKRGLKFKQGSIVTYVVTKKGKSISDKARVIDFVEEGDYDPDYYINNQVLPSVLRILEALGYSEDELKGLGKQMKLGGF

SEQ ID NO: 236 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSSAGSIIISHNIDPSTIDCECCPEDSYRSPTGHYFCKKKRGLIPETLNELVQRRIEVKKGLKNEKNPERRRFLDVKQQSLKLLANSMYGYFGFPRARWYCLESAESITALGRKYHLHTIDIVPKFGFDVIYGDTDSVYLIKPNITDRERVMKDAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 237 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIPDNILLFDFRSLYPSIIISHNIDPSTIDCECCPEDSYRSPTGHYFCKKKRGLIPETLNELVQRRIEVKKGLKNEKNPERRRFLDVKQQVLVLLAASMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 238 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSIGASIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYLLHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 239 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELRGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSSAGSIIISHNIDPSTIDCECCPEDSYRSPTGHYFCKKKRGLIPETLNELVQRRIEVKKGLKNEKNPERRRFLDVKQQSLKLLANSMYGYFGFPRARWYCLECAESITALGRKYHLHTIDIVPKFGFDVIYGDTDSVYLIKPNITDRERVMKDAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 240 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSSATSIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYHLHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 241 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSLYPSIIISHNIDPSTIDCECCPEDSYRSPTGHYFCKKKRGLIPETLNELVQRRIEVKKGLKNEKNPERRRFLDVKQQALKLLANSMGGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 242 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSVVGSIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 243 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSLYPSIIISHNIDPSTIDCECCPEDSYRSPTGHYFCKKKRGLIPETLNELVQRAIEVKKGLKNEKNPERRRFLDVKQQALKLLANSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 244 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSAAGSIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 245 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRGLYSSIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 246 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSSAGSIIISHNIDPSTIDCECCPEDSYRSPTGHYFCKKKRGLIPETLNELVQRRIEVKKGLKNEKNPERRRFLDVKQRALKLLANSMYGYFGFPRARWYCRECAESITALGRKYHLHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTIITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 247 - protein, 773 aa, Artificial Sequence
  Description of Artificial Sequence: Synthetic polypeptide
MKKTLLDADYFTREEKAVVRLFYKTEEGREIQEVADFRPYMYVLPEEHDLKKLQREIKELKNITNVEIKRMIEGDREVEVLKVMVNQPRDVPNLRGLIKELEGCREVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSFAGSIIISHNIDPSTIDCECCPEDSYRSPTGHYFCKKKRGLIPETLNELVQRRIEVKKGLKNEKNPERRRFLDVKQQSLKLLANSMYGYFGFPRARWYCLECAESITALGRKYHLHTIDIVPKFGFDVIYGDTDSVYLIKPNITDRERVMKDAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 248 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELENITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSFAGSIIISHNIDPSTIDCECCPEDSYRSPTGHYFCKKKRGLIPETLNELVQRRIEVKKGLKNEKNPERRRFLDVKQQSLKLLANSMYGYFGFPRARWYCLECAESITALGRKYHLHTIDIVPKFGFDVIYGDTDSVYLIKPNITDRERVMKDAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 249 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSLASSIIISHNIDPSTIDCECCPEDSYRSPTGHYFCKKKRGLIPETLNELVQRRIEVKKGLKNEKNPERRRFLDVKQQALKLLANSMRGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 250 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSIAGSIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 251 - protein, 773 aa, Artificial Sequence
  Description of Artificial Sequence: Synthetic polypeptide
MKKTLLDADFITRKEKAVVRLFYKTEEGREIQEVADFRPYMYVLPEERDLKKLQREIKELKNITNVEIKRMIEGNREVEVLKVMVNQPRDVPNLRGLIKELEGVKEVREAHIPFVERYLIDSGLIPMQDVENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSFAPSIIISHNIDPSTIDCECCPEDSYRSPTGHYFCKKKRGLIPETLNELVQRRIEVKKGLKNEKNPERRRFLDVKQQALKLLANSMYGYFGFPRARWYCLECAESISALGRKYHLHTIDIVPKFGFDVIYGDTDSVYLIKPNITDRERVMKDAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMADYKTEGPHIVAAKKAMKRGLEFKQGDIVTYVVTKKGKSISDKARVIDFVEEGDYDPDYYINNQVLPSVLRILEALGYSEDELKGLGKQMKLGGF

SEQ ID NO: 252 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSFAPSIIISHNIDPSTIDCECCPEDSYRSPTGHYFCKKKRGLIPETLNELVQRRIEVKKGLKNEKNPERRRFLDVKQQSLKLLANSMYGYFGSPRARWYCLECAESITALGRKYHLHTIDIVPKFGFDVIYGDTDSVYLIKPNITDRERVMKDAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 253 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKRKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSSAGSIIISHNIDPSTIDCECCPEDSYRSPTGHYFCKKKRGLIPETLNELVQRRIEVKKGLKNEKNPERRRFLDVKQQSLKLLANSMYGYFGFPRARWYCLECAESITALGRKYHLHTIDIVPKFGFDVIYGDTDSVYLIKPNITDRERVMKDAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 254 - protein, 773 aa, Artificial Sequence
  Description of Artificial Sequence: Synthetic polypeptide
MKKTLLDADYITRKEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSFAGSIIISHNIDPSTIDCECCPEDSYRSPTGHYFCKKKRGLIPETLNELVQRRIEVKKGLKNEKNPERRRFLDVKQQSLKLLANSMYGYFGFPRARWYCLECAESITALGRKYHLHTIDIVPKFGFDVIYGDTDSVYLIKPNITDRERVMKDAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 255 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSLYPSIIISHNIDPSTIDCECCPEDSYRSPTGHYFCKKKRGLIPETLNELVQRRIEVKKGLKNEKNPERRRFLDVKQQVLGLLAGSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 256 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSSAGSIIISHNIDPSTIDCECCPEDSYRSPTGHYFCKKKRGLIPETLNELVQRRIEVKKGLKNEKNPERRRFLDVKQQSLKLLANSMYGYFGFPRARWYCLECAESITALGRKYHLHTIDIVPKFGFDVIYGDTDSVYLIKPNITDRERVMKNAEHFLDKINSELPEAMELEFEGFYPRGIFITKKRYALIDERGELIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 257 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSFAGSIIISHNIDPSTIDCECCPEDSYRSPTGHYFCKKKRGLIPETLNELVQRRIEVKKGLKNEKNPERRRFLDVKQQSLKLLANSIYGYFGFPRARWYCLECAESITALGRKYHLHTIDIVPKFGFDVIYGDTDSVYLIKPNITDRERVMKDAEHFLDKINSELPEAMELEFEGFYPRGIFITKKRYALIDERGKLIVKGLETKRRDWANIAKDTQEKVLDALLKDKNPEKAASIVKDVIRDIKTGKIPLKDLAINTQITRGMAEYKTEGPHIVAAKKAMKRGLKFKQGDIVTYVVTKKGKSISDKARVIDFVEEGDYDPDYYINNQVLPSVLRILEALGYSEDELKGLGKQMKLGGF

SEQ ID NO: 258-268 - skipped (11 entries)

SEQ ID NO: 269 - protein, 135 aa, Unknown
  Description of Unknown: Candidatus Altiarchaeales archaeon sequence
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDL

SEQ ID NO: 270 - protein, 212 aa, Unknown
  Description of Unknown: Candidatus Altiarchaeales archaeon sequence
RIAAFDMEVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITREL

SEQ ID NO: 271 - protein, 107 aa, Unknown
  Description of Unknown: Candidatus Altiarchaeales archaeon sequence
IYQSSRAGSGQRVESLLIKKAFEKSILVPNRPSDRVVNERQRKTYIGAYVVEPKRGIHDNILLFDFRSLYPSIIISHNIDPSTIDCECCPEDSYRSPTGHYFCKKKR

SEQ ID NO: 272 - protein, 50 aa, Unknown
  Description of Unknown: Candidatus Altiarchaeales archaeon sequence
GLIPETLNELVQRRIEVKKGLKNEKNPERRRFLDVKQQALKLLANSMYGY

SEQ ID NO: 273 - protein, 120 aa, Unknown
  Description of Unknown: Candidatus Altiarchaeales archaeon sequence
FGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWA

SEQ ID NO: 274 - protein, 149 aa, Unknown
  Description of Unknown: Candidatus Altiarchaeales archaeon sequence
NIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 275 - protein, 876 aa, Geobacillus stearothermophilus
MKKKLVLIDGNSVAYRAFFALPLLHNDKGIHTNAVYGFTMMLNKILAEEQPTHLLVAFDAGKTTFRHETFQEYKGGRQQTPPELSEQFPLLRELLKAYRIPAYELDHYEADDIIGTLAARAEQEGFEVKIISGDRDLTQLASRHVTVDITKKGITDIEPYTPETVREKYGLTPEQIVDLKGLMGDKSDNIPGVPGIGEKTAVKLLKQFGTVENVLASIDEVKGEKLKENLRQHRDLALLSKQLASICRDAPVELSLDDIVYEGQDREKVIALFKELGFQSFLEKMAAPAAEGEKPLEEMEFAIVDVITEEMLADKAALVVEVMEENYHDAPIVGIALVNEHGRFFMRPETALADSQFLAWLADETKKKSMFDAKRAVVALKWKGIELRGVAFDLLLAAYLLNPAQDAGDIAAVAKMKQYEAVRSDEAVYGKGVKRSLPDEQTLAEHLVRKAAAIWALEQPFMDDLRNNEQDQLLTKLEQPLAAILAEMEFTGVNVDTKRLEQMGSELAEQLRAIEQRIYELAGQEFNINSPKQLGVILFEKLQLPVLKKTKTGYSTSADVLEKLAPHHEIVENILHYRQLGKLQSTYIEGLLKVVRPDTGKVHTMFNQALTQTGRLSSAEPNLQNIPIRLEEGRKIRQAFVPSEPDWLIFAADYSQIELRVLAHIADDDNLIEAFQRDLDIHTKTAMDIFHVSEEEVTANMRRQAKAVNFGIVYGISDYGLAQNLNITRKEAAEFIERYFASFPGVKQYMENIVQEAKQKGYVTTLLHRRRYLPDITSRNFNVRSFAERTAMNTPIQGSAADIIKKAMIDLAARLKEEQLQARLLLQVHDELILEAPKEEIERLCELVPEVMEQAVTLRVPLKVDYHYGPTWYDAK

SEQ ID NO: 276 - protein, 876 aa, Artificial Sequence
  Description of Artificial Sequence: Synthetic polypeptide
MKKKLVLIDGNSVAYRAFFALPLLHNDKGIHTNAVYGFTMMLNKILAEEQPTHLLVAFDAGKTTFRHETFQEYKGGRQQTPPELSEQFPLLRELLKAYRIPAYELDHYEADDIIGTLAARAEQEGFEVKIISGDRDLTQLASRHVTVDITKKGITDIEPYTPETVREKYGLTPEQIVDLKGLMGDKSDNIPGVPGIGEKTAVKLLKQFGTVENVLASIDEVKGEKLKENLRQHRDLALLSKQLASICRDAPVELSLDDIVYEGQDREKVIALFKELGFQSFLEKMAAPAAEGEKPLEEMEFAIVDVITEEMLADKAALVVEVMEENYHDAPIVGIALVNEHGRFFMRPETALADSQFLAWLADETKKKSMFDAKRAVVALKWKGIELRGVAFDLLLAAYLLNPAQDAGDIAAVAKMKQYEAVRSDEAVYGKGVKRSLPDEQTLAEHLVRKAAAIWALEQPFMDDLRNNEQDQLLTKLEQPLAAILAEMEFTGVNVDTKRLEQMGSELAEQLRAIEQRIYELAGQEFNINSPKQLGVILFEKLQLPVLKKTKTGYSTSADVLEKLAPHHEIVENILHYRQLGKLQSTYIEGLLKVVRPDTGKVHTMFNQALTQTGRLSSAEPNLQNIPIRLEEGRKIRQAFVPSEPDWLIFAADYSSIELRVLAHIADDDNLIEAFQRDLDIHTKTAMDIFHVSEEEVTANMRRQAKAVNFGIVYGISDYGLAQNLNITRKEAAEFIERYFASFPGVKQYMENIVQEAKQKGYVTTLLHRRRYLPDITSRNFNVRSFAERTAMNTPIQGSAADIIKKAMIDLAARLKEEQLQARLLLQVHDELILEAPKEEIERLCELVPEVMEQAVTLRVPLKVDYHYGPTWYDAK

SEQ ID NO: 277 - protein, 876 aa, Artificial Sequence
  Description of Artificial Sequence: Synthetic polypeptide
MKKKLVLIDGNSVAYRAFFALPLLHNDKGIHTNAVYGFTMMLNKILAEEQPTHLLVAFDAGKTTFRHETFQEYKGGRQQTPPELSEQFPLLRELLKAYRIPAYELDHYEADDIIGTLAARAEQEGFEVKIISGDRDLTQLASRHVTVDITKKGITDIEPYTPETVREKYGLTPEQIVDLKGLMGDKSDNIPGVPGIGEKTAVKLLKQFGTVENVLASIDEVKGEKLKENLRQHRDLALLSKQLASICRDAPVELSLDDIVYEGQDREKVIALFKELGFQSFLEKMAAPAAEGEKPLEEMEFAIVDVITEEMLADKAALVVEVMEENYHDAPIVGIALVNEHGRFFMRPETALADSQFLAWLADETKKKSMFDAKRAVVALKWKGIELRGVAFDLLLAAYLLNPAQDAGDIAAVAKMKQYEAVRSDEAVYGKGVKRSLPDEQTLAEHLVRKAAAIWALEQPFMDDLRNNEQDQLLTKLEQPLAAILAEMEFTGVNVDTKRLEQMGSELAEQLRAIEQRIYELAGQEFNINSPKQLGVILFEKLQLPVLKKTKTGYSTSADVLEKLAPHHEIVENILHYRQLGKLQSTYIEGLLKVVRPDTGKVHTMFNQALTQTGRLSSAEPNLQNIPIRLEEGRKIRQAFVPSEPDWLIFAADYSAIELRVLAHIADDDNLIEAFQRDLDIHTKTAMDIFHVSEEEVTANMRRQAKAVNFGIVYGISDYGLAQNLNITRKEAAEFIERYFASFPGVKQYMENIVQEAKQKGYVTTLLHRRRYLPDITSRNFNVRSFAERTAMNTPIQGSAADIIKKAMIDLAARLKEEQLQARLLLQVHDELILEAPKEEIERLCELVPEVMEQAVTLRVPLKVDYHYGPTWYDAK

SEQ ID NO: 278 - protein, 876 aa, Artificial Sequence
  Description of Artificial Sequence: Synthetic polypeptide
MKKKLVLIDGNSVAYRAFFALPLLHNDKGIHTNAVYGFTMMLNKILAEEQPTHLLVAFDAGKTTFRHETFQEYKGGRQQTPPELSEQFPLLRELLKAYRIPAYELDHYEADDIIGTLAARAEQEGFEVKIISGDRDLTQLASRHVTVDITKKGITDIEPYTPETVREKYGLTPEQIVDLKGLMGDKSDNIPGVPGIGEKTAVKLLKQFGTVENVLASIDEVKGEKLKENLRQHRDLALLSKQLASICRDAPVELSLDDIVYEGQDREKVIALFKELGFQSFLEKMAAPAAEGEKPLEEMEFAIVDVITEEMLADKAALVVEVMEENYHDAPIVGIALVNEHGRFFMRPETALADSQFLAWLADETKKKSMFDAKRAVVALKWKGIELRGVAFDLLLAAYLLNPAQDAGDIAAVAKMKQYEAVRSDEAVYGKGVKRSLPDEQTLAEHLVRKAAAIWALEQPFMDDLRNNEQDQLLTKLEQPLAAILAEMEFTGVNVDTKRLEQMGSELAEQLRAIEQRIYELAGQEFNINSPKQLGVILFEKLQLPVLKKTKTGYSTSADVLEKLAPHHEIVENILHYRQLGKLQSTYIEGLLKVVRPDTGKVHTMFNQALTQTGRLSSAEPNLQNIPIRLEEGRKIRQAFVPSEPDWLIFAADYSAAALRVLAHIADDDNLIEAFQRDLDIHTKTAMDIFHVSEEEVTANMRRQAKAVNFGIVYGISDYGLAQNLNITRKEAAEFIERYFASFPGVKQYMENIVQEAKQKGYVTTLLHRRRYLPDITSRNFNVRSFAERTAMNTPIQGSAADIIKKAMIDLAARLKEEQLQARLLLQVHDELILEAPKEEIERLCELVPEVMEQAVTLRVPLKVDYHYGPTWYDAK

SEQ ID NO: 279 - protein, 876 aa, Artificial Sequence
  Description of Artificial Sequence: Synthetic polypeptide
MKKKLVLIDGNSVAYRAFFALPLLHNDKGIHTNAVYGFTMMLNKILAEEQPTHLLVAFDAGKTTFRHETFQEYKGGRQQTPPELSEQFPLLRELLKAYRIPAYELDHYEADDIIGTLAARAEQEGFEVKIISGDRDLTQLASRHVTVDITKKGITDIEPYTPETVREKYGLTPEQIVDLKGLMGDKSDNIPGVPGIGEKTAVKLLKQFGTVENVLASIDEVKGEKLKENLRQHRDLALLSKQLASICRDAPVELSLDDIVYEGQDREKVIALFKELGFQSFLEKMAAPAAEGEKPLEEMEFAIVDVITEEMLADKAALVVEVMEENYHDAPIVGIALVNEHGRFFMRPETALADSQFLAWLADETKKKSMFDAKRAVVALKWKGIELRGVAFDLLLAAYLLNPAQDAGDIAAVAKMKQYEAVRSDEAVYGKGVKRSLPDEQTLAEHLVRKAAAIWALEQPFMDDLRNNEQDQLLTKLEQPLAAILAEMEFTGVNVDTKRLEQMGSELAEQLRAIEQRIYELAGQEFNINSPKQLGVILFEKLQLPVLKKTKTGYSTSADVLEKLAPHHEIVENILHYRQLGKLQSTYIEGLLKVVRPDTGKVHTMFNQALTQTGRLSSAEPNLQNIPIRLEEGRKIRQAFVPSEPDWLIFAADYSSAALRVLAHIADDDNLIEAFQRDLDIHTKTAMDIFHVSEEEVTANMRRQAKAVNFGIVYGISDYGLAQNLNITRKEAAEFIERYFASFPGVKQYMENIVQEAKQKGYVTTLLHRRRYLPDITSRNFNVRSFAERTAMNTPIQGSAADIIKKAMIDLAARLKEEQLQARLLLQVHDELILEAPKEEIERLCELVPEVMEQAVTLRVPLKVDYHYGPTWYDAK

SEQ ID NO: 280 - protein, 775 aa, Thermococcus sp.
MILDTDYITENGKPVIRVFKKENGEFKIEYDRTFEPYFYALLKDDSAIEDVKKVTAKRHGTVVKVKRAEKVQKKFLGRPIEVWKLYFNHPQDVPAIRDRIRAHPAVVDIYEYDIPFAKRYLIDKGLIPMEGDEELTMLAFDIETLYHEGEEFGTGPILMISYADGSEARVITWKKIDLPYVDVVSTEKEMIKRFLRVVREKDPDVLITYNGDNFDFAYLKKRCEELGIKFTLGRDGSEPKIQRMGDRFAVEVKGRIHFDLYPVIRRTINLPTYTLEAVYEAVFGKPKEKVYAEEIAQAWESGEGLERVARYSMEDAKVTYELGREFFPMEAQLSRLIGQSLWDVSRSSTGNLVEWFLLRKAYKRNELAPNKPDERELARRRGGYAGGYVKEPERGLWDNIVYLDFRSLYPSIIITHNVSPDTLNREGCKEYDVAPEVGHKFCKDFPGFIPSLLGDLLEERQKIKRKMKATVDPLEKKLLDYRQRAIKILANSFYGYYGYAKARWYCKECAESVTAWGREYIEMVIRELEEKFGFKVLYADTDGLHATIPGADAETVKKKAKEFLKYINPKLPGLLELEYEGFYVRGFFVTKKKYAVIDEEGKITTRGLEIVRRDWSEIAKETQARVLEAILKHGDVEEAVRIVKEVTEKLSKYEVPPEKLVIHEQITRDLRDYKATGPHVAVAKRLAARGVKIRPGTVISYIVLKGSGRIGDRAIPADEFDPTKHRYDAEYYIENQVLPAVERILKAFGYRKEDLRYQKTKQVGLGAWLKVKGKK

SEQ ID NO: 281 - protein, 775 aa, Thermococcus sp.; identical to SEQ ID NO: 280

SEQ ID NO: 282 - protein, 775 aa, Artificial Sequence
  Description of Artificial Sequence: Synthetic polypeptide
MILDTDYITENGKPVIRVFKKENGEFKIEYDRTFEPYFYALLKDDSAIEDVKKVTAKRHGTVVKVKRAEKVQKKFLGRPIEVWKLYFNHPQDVPAIRDRIRAHPAVVDIYEYDIPFAKRYLIDKGLIPMEGDEELTMLAFAIATLYHEGEEFGTGPILMISYADGSEARVITWKKIDLPYVDVVSTEKEMIKRFLRVVREKDPDVLITYNGDNFDFAYLKKRCEELGIKFTLGRDGSEPKIQRMGDRFAVEVKGRIHFDLYPVIRRTINLPTYTLEAVYEAVFGKPKEKVYAEEIAQAWESGEGLERVARYSMEDAKVTYELGREFFPMEAQLSRLIGQSLWDVSRSSTGNLVEWFLLRKAYKRNELAPNKPDERELARRRGGYAGGYVKEPERGLWDNIVYLDFRSLYPSIIITHNVSPDTLNREGCKEYDVAPEVGHKFCKDFPGFIPSLLGDLLEERQKIKRKMKATVDPLEKKLLDYRQRLIKILANSFYGYYGYAKARWYCKECAESVTAWGREYIEMVIRELEEKFGFKVLYADTDGLHATIPGADAETVKKKAKEFLKYINPKLPGLLELEYEGFYVRGFFVTKKKYAVIDEEGKITTRGLEIVRRDWSEIAKETQARVLEAILKHGDVEEAVRIVKEVTEKLSKYEVPPEKLVIHEQITRDLRDYKATGPHVAVAKRLAARGVKIRPGTVISYIVLKGSGRIGDRAIPADEFDPTKHRYDAEYYIENQVLPAVERILKAFGYRKEDLRYQKTKQVGLGAWLKVKGKK

SEQ ID NO: 283 - protein, 1702 aa, Artificial Sequence
  Description of Artificial Sequence: Synthetic polypeptide
MILDTDYITKDGKPIIRIFKKENGEFKIELDPHFQPYIYALLKDDSAIEEIKAIKGERHGKTVRVLDAVKVRKKFLGREVEVWKLIFEHPQDVPAMRGKIREHPAVVDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKEHPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCKNYDVAPIVGYRFCKDFPGFIPSILGDLIAMRQDIKKKMKSTIDPIEKKMLDYRQRAIKLLANSILPNEWLPIIENGEIKFVKIGEFINSYMEKQKENVKTVENTEVLEVNNLFAFSFNKKIKESEVKKVKALIRHKYKGKAYEIQLSSGRKINITAGHSLFTVRNGEIKEVSGDGIKEGDLIVAPKKIKLNEKGVSINIPELISDLSEEETADIVMTISAKGRKNFFKGMLRTLRWMFGEENRRIRTFNRYLFHLEKLGLIKLLPRGYEVTDWERLKKYKQLYEKLAGSVKYNGNKREYLVMFNEIKDFISYFPQKELEEWKIGTLNGFRTNCILKVDEDFGKLLGYYVSEGYAGAQKNKTGGISYSVKLYNEDPNVLESMKNVAEKFFGKVRVDRNCVSISKKMAYLVMKCLCGALAENKRIPSVILTSPEPVRWSFLEAYFTGDGDIHPSKRFRLSTKSELLANQLVFLLNSLGISSVKIGFDSGVYRVYINEDLQFPQTSREKNTYYSNLIPKEILRDVFGKEFQKNMTFKKFKELVDSGKLNREKAKLLEFFINGDIVLDRVKSVKEKDYEGYVYDLSVEDNENFLVGFGLLYAHNSYYGYMGYPKARWYSKECAESVTAWGRHYIEMTIREIEEKFGFKVLYADSVSGESEIIIRQNGKIRFVKIKDLFSKVDYSIGEKEYCILEGVEALTLDDDGKLVWKPVPYVMRHRANKRMFRIWLTNSWYIDVTEDHSLIGYLNTSKTKTAKKIGERLKEVKPFELGKAVKSLICPNAPLKDENTKTSEIAVKFWELVGLIVGDGNWGGDSRWAEYYLGLSTGKDAEEIKQKLLEPLKTYGVISNYYPKNEKGDFNILAKSLVKFMKRHFKDEKGRRKIPEFMYELPVTYIEAFLRGLFSADGTVTIRKGVPEIRLTNIDADFLREVRKLLWIVGISNSIFAETTPNRYNGVSTGTYSKHLRIKNKWRFAERIGFLIERKQKRLLEHLKSARVKRNTIDFGFDLVHVKKVEEIPYEGYVYDIEVEETHRFFANNILVHNTDGFYATIPGEKPELIKKKAKEFLNYINSKLPGLLELEYEGFYLRGFFVTKKRYAVIDEEGRITTRGLEVVRRDWSEIAKETQAKVLEAILKEGSVEKAVEVVRDVVEKIAKYRVPLEKLVIHEQITRDLKDYKAIGPHVAIAKRLAARGIKVKPGTIISYIVLKGSGKISDRVILLTEYDPRKHKYDPDYYIENQVLPAVLRILEAFGYRKEDLRYQSSKQTGLDAWLKR

SEQ ID NO: 284 - protein, 1312 aa, Artificial Sequence
  Description of Artificial Sequence: Synthetic polypeptide
MILDADYITEDGKPIIRIFKKENGEFKVEYDRNFRPYIYALLKDDSQIDEVRKITAERHGKIVRIIDAEKVRKKFLGRPIEVWRLYFEHPQDVPAIRDKIREHSAVIDIFEYDIPFAKRYLIDKGLIPMEGDEELKLLAFDIETLYHEGEEFAKGPIIMISYADEEEAKVITWKKIDLPYVEVVSSEREMIKRFLKVIREKDPDVIITYNGDSFDLPYLVKRAEKLGIKLPLGRDGSEPKMQRLGDMTAVEIKGRIHFDLYHVIRRTINLPTYTLEAVYEAIFGKPKEKVYAHEIAEAWETGKGLERVAKYSMEDAKVTYELGREFFPMEAQLSRLVGQPLWDVSRSSTGNLVEWYLLRKAYERNELAPNKPDEREYERRLRESYAGGYVKEPEKGLWEGLVSLDFRSLYPSIIITHNVSPDTLNREGCREYDVAPEVGHKFCKDFPGFIPSLLKRLLDERQEIKRKMKASKDPIEKKMLDYRQRAIKILANSILPEEWVPLIKNGKVKIFRIGDFVDGLMKANQGKVKKTGDTEVLEVAGIHAFSFDRKSKKARVMAVKAVIRHRYSGNVYRIVLNSGRKITITEGHSLFVYRNGDLVEATGEDVKIGDLLAVPRSVNLPEKRERLNIVELLLNLSPEETEDIILTIPVKGRKNFFKGMLRTLRWIFGEEKRVRTASRYLRHLENLGYIRLRKIGYDIIDKEGLEKYRTLYEKLVDVVRYNGNKREYLVEFNAVRDVISLMPEEELKEWRIGTRNGFRMGTFVDIDEDFAKLLGYYVSEGSARKWKNQTGGWSYTVRLYNENDEVLDDMEHLAKKFFGKVKRGKNYVEIPKKMAYIIFESLCGTLAENKRVPEVIFTSSKGVRWAFLEGYFIGDGDVHPSKRVRLSTKSELLVNGLVLLLNSLGVSAIKLGYDSGVYRVYVNEELKFTEYRKKKNVYHSHIVPKDILKETFGKVFQKNISYKKFRELVENGKLDREKAKRIEWLLNGDIVLDRVVEIKREYYDGYVYDLSVDEDENFLAGFGFLYAHNSYYGYYGYAKARWYCKECAESVTAWGREYIEFVRKELEEKFGFKVLYIDTDGLYATIPGAKPEEIKKKALEFVDYINAKLPGLLELEYEGFYVRGFFVTKKKYALIDEEGKIITRGLEIVRRDWSEIAKETQAKVLEAILKHGNVEEAVKIVKEVTEKLSKYEIPPEKLVIYEQITRPLHEYKAIGPHVAVAKRLAARGVKVRPGMVIGYIVLRGDGPISKRAILAEEFDLRKHKYDAEYYIENQVLPAVLRILEAFGYRKEDLRWQKTKQTGLTAWLNIKKK

SEQ ID NO: 285 - protein, 775 aa, Pyrococcus furiosus
MILDVDYITEEGKPVIRLFKKENGKFKIEHDRTFRPYIYALLRDDSKIEEVKKITGERHGKIVRIVDVEKVEKKFLGKPITVWKLYLEHPQDVPTIREKVREHPAVVDIFEYDIPFAKRYLIDKGLIPMEGEEELKILAFDIETLYHEGEEFGKGPIIMISYADENEAKVITWKNIDLPYVEVVSSEREMIKRFLRIIREKDPDIIVTYNGDSFDFPYLAKRAEKLGIKLTIGRDGSEPKMQRIGDMTAVEVKGRIHFDLYHVITRTINLPTYTLEAVYEAIFGKPKEKVYADEIAKAWESGENLERVAKYSMEDAKATYELGKEFLPMEIQLSRLVGQPLWDVSRSSTGNLVEWFLLRKAYERNEVAPNKPSEEEYQRRLRESYTGGFVKEPEKGLWENIVYLDFRALYPSIIITHNVSPDTLNLEGCKNYDIAPQVGHKFCKDIPGFIPSLLGHLLEERQKIKTKMKETQDPIEKILLDYRQKAIKLLANSFYGYYGYAKARWYCKECAESVTAWGRKYIELVWKELEEKFGFKVLYIDTDGLYATIPGGESEEIKKKALEFVKYINSKLPGLLELEYEGFYKRGFFVTKKRYAVIDEEGKVITRGLEIVRRDWSEIAKETQARVLETILKHGDVEEAVRIVKEVIQKLANYEIPPEKLAIYEQITRPLHEYKAIGPHVAVAKKLAAKGVKIKPGMVIGYIVLRGDGPISNRAILAEEYDPKKHKYDAEYYIENQVLPAVLRILEGFGYRKEDLRYQKTRQVGLTSWLNIKKS

SEQ ID NO: 286 - protein, 771 aa, Pyrococcus sp.
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPMEGNEELTFLAVDIETLYHEGEEFGKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSLYPSIIITHNVSPDTLNRENCKEYDVAPQVGHRFCKDFPGFIPSLLGNLLEERQKIKKRMKESKDPVEKKLLDYRQRAIKILANSYYGYYGYAKARWYCKECAESVTAWGRQYIDLVRRELESRGFKVLYIDTDGLYATIPGAKHEEIKEKALKFVEYINSKLPGLLELEYEGFYARGFFVTKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 287 - protein, 903 aa, Escherichia virus
MKEFYLTVEQIGDSIFERYIDSNGRERTREVEYKPSLFAHCPESQATKYFDIYGKPCTRKLFANMRDASQWIKRMEDIGLEALGMDDFKLAYLSDTYNYEIKYDHTKIRVANFDIEVTSPDGFPEPSQAKHPIDAITHYDSIDDRFYVFDLLNSPYGNVEEWSIEIAAKLQEQGGDEVPSEIIDKIIYMPFDNEKELLMEYLNFWQQKTPVILTGWNVESFDIPYVYNRIKNIFGESTAKRLSPHRKTRVKVIENMYGSREIITLFGISVLDYIDLYKKFSFTNQPSYSLDYISEFELNVGKLKYDGPISKLRESNHQRYISYNIIDVYRVLQIDAKRQFINLSLDMGYYAKIQIQSVFSPIKTWDAIIFNSLKEQNKVIPQGRSHPVQPYPGAFVKEPIPNRYKYVMSFDLTSLYPSIIRQVNISPETIAGTFKVAPLHDYINAVAERPSDVYSCSPNGMMYYKDRDGVVPTEITKVFNQRKEHKGYMLAAQRNGEIIKEALHNPNLSVDEPLDVDYRFDFSDEIKEKIKKLSAKSLNEMLFRAQRTEVAGMTAQINRKLLINSLYGALGNVWFRYYDLRNATAITTFGQMALQWIERKVNEYLNEVCGTEGEAFVLYGDTDSIYVSADKIIDKVGESKFRDTNHWVDFLDKFARERMEPAIDRGFREMCEYMNNKQHLMFMDREAIAGPPLGSKGIGGFWTGKKRYALNVWDMEGTRYAEPKLKIMGLETQKSSTPKAVQKALKECIRRMLQEGEESLQEYFKEFEKEFRQLNYISIASVSSANNIAKYDVGGFPGPKCPFHIRGILTYNRAIKGNIDAPQVVEGEKVYVLPLREGNPFGDKCIAWPSGTEITDLIKDDVLHWMDYTVLLEKTFIKPLEGFTSAAKLDYEKKASLFDMFDF

SEQ ID NO: 288 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSAYGSIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 289 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSSAGSIIISHNIDPSTIDCECCPEDSYRSPTGHYFCKKKRGLIPETLNELVQRRIEVKKGLKNEKNPERRRFLDVKQQSLKLLANSMYGYFGFPRARWYCRECAESITALGRKYHLHTIDIVPKFGFDVIYGDTDSVYLIKPNITDRERVMKNAGHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 290 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDRENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSSAGSIIISHNIDPSTIDCECCPEDSYRSPTGHYFCKKKRGLIPETLNELVQRRIEVKKGLKNEKNPERRRFLDVKQQSLKLLANSMYGYFGFPRARWYCLECAESITALGRKYHLHTIDIVPKFGFDVIYGDTDSVYLIKPNITDRERVMKDAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 291 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSSAGSIIISHNIDPSTIDCECCPEDSYRSPTGHYFCKKKRGLIPETLNELVQRRIEVKKGLKNEKNPERRRFLDVKQQSLKLLANSMYGYFGFPRARWYCLECAESITALGRKYHLHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKGISDKARVIDFVEEGDYDPDYYINNQVLPSVLRILEALGYSEDELKGLGKQMKLGGF

SEQ ID NO: 292 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSSGPSIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 293 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIMELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSFAGSIIISHNIDPSTIDCECCPEDSYRSPTGHYFCKKKRGLIPETLNELVQRRIEVKKGLKNEKNPERRRFLDVKQQSLKLLANSMYGYFGFPRARWYCLECAESITALGRKYHLHTIDIVPKFGFDVIYGDTDSVYLIKPNITDRERVMKDAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 294 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSFAASIIISHNIDPSTIDCECCPEDSYRSPTGHYFCKKKRGLIPETLNELVQRRIEVKKGLKNEKNPERRRFLDVKQQSLKLLANGMYGYFGFPRARWYCLECAESITALGRKYHLHTIDIVPKFGFDVIYGDTDSVYLIKPNITDRERVMKDAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 295 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSLYPSIIISHNIDPSTIDCECCPEDSYRSPTGHYFCKKKRGLIPETLNELVQRRIEVKKGLKNEKNPERRRFLDVKQQVLQLLAGSMYGYFGSPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 296 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRAISHNILLFDFRSLYPSIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 297 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSSAGSIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYHLHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 298 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSFAGSIIISHNIDPSTIDCECCPEDSYRSPTGHYFCKKKRGLIPETLNELVQRRIEVKKGLKNEKNPERRRFLDVKQQSLKLLANSIYGYFGFPRARWYCLECAESITALGRKYHLHTIDIVPKFGFDVIYGDTDSVYLIKPNITDRERVMKDAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKNISDKARVIDFVEEGDYDPDYYINNQVLPCVLRILEALGYSEDELKGLGKQMKLGGF

SEQ ID NO: 299 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSLYPSIIISHNIDPSTIDCECCPEDSYRSPTGHYFCKKKRGLIPETLNELVQRRIEVKKGLKNEKNPERRRFLDVKQQVLALLAGSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 300 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSLYPSIIISHNIDPSTIDCECCPEDSYRSPTGHYFCKKKRGLIPETLNELVQRRIEVKKGLKNEKNPERRRFLDVKQQALKLLANSMHGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 301 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCESFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSFAGSIIISHNIDPSTIDCECCPEDSYRSPTGHYFCKKKRGLIPETLNELVQRRIEVKKGLKNEKNPERRRFLDVKQQSLKLLANSMYGYFGFPRARWYCLECAESITALGRKYHLHTIDIVPKFGFDVIYGDTDSVYLIKPNITDRERVMKDAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 302 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSASASIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 303 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSIIVSIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 304 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRVVYPSIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 305 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSLSGSIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 306 - protein, 773 aa, Artificial Sequence; identical to SEQ ID NO: 163
  Description of Artificial Sequence: Synthetic polypeptide

SEQ ID NO: 307 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSVYPSIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 308 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSSYVSIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 309 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRVLYGSIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 310 - protein, 773 aa, Artificial Sequence
  Description of Artificial Sequence: Synthetic polypeptide
MKKTLLDADYITREEKAVVRLFYKTEEGREIQEVADFRPYMYVLPEERDLKKLQREIKELKNITNVEIKRMIEGNREVEVLKVMVNQPRDVPNLRGLIKELEGCKEVREAHIPFVERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSFAGSIIISHNIDPSTIDCECCPEDSYRSPTGHYFCKKKRGLIPETLNELVQRRIEVKKGLKNEKNPERRRFLDVKQQSLKLLANSIYGYFGFPRARWYCLECAESITALGRKYHLHTIDIVPKFGFDVIYGDTDSVYLIKPNITDRERVMKDAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGDIVTYVVTKKGKSISDKARVIDFVEEGDYDPDYYINNQVLPSVLRILEALGYSEDELKGLGKQMKLGGF

SEQ ID NO: 311 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSFAGSIIISHNIDPSTIDCRCCPEDSYRSPTGHYFCKKKRGLIPETLNELVQRRIEVKKGLKNEKNPERRRFLDVKQQSLKLLANSIYGYFGFPRARWYCLECAESITALGRKYHLHTIDIVPKFGFDVIYGDTDSVYLIKPNITDRERVMKDAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 312 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSLYPSIIISHNIDPSTIDCECCPEDSYRSPTGHYFCKKKRGLIPETLNELVQRRIEVKKGLKNEKNPERRRFLDVKQQALKLLANSMFGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 313 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSFAGSIIISHNIDPSTIDCECCPEDSYRSPTGHYFCKKKRGLIPETLNELVQRRIEVKKSLKNEKNPERRRFLNVKQQSLKLLANSMYGYFGFPRARWYCLECAESITALGRKYHLHTIDIVPKFGFDVIYGDTDSVYLIKPNITDRERVMKDAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 314 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSAGASIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 315 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSSAGSIIISHNIDPSTIDCECCPEDSYRSPTGHYFCKKKRGLIPETLNELVQRRIEVKKGLKNEKNPERRRFLDVKQQSLKLLANSMYGYFGFPRARWYCRECAESITALGRKYHLHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKAHVIDFVEEGDYDPDYYINNQVLPSVLRILEALGYSEDELKGLGKQMKLGGF

SEQ ID NO: 316 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRGLYVSIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 317 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSLYPSIIISHNIDPSTIDCECCPEDSYRSPTGHYFCKKKRGLIPETLNELVQRRIEVKKGLKNEKNPERRRFLDVKQQVLSLLASSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 318 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSLYPSIIISHNIDPSTIDCECCPEDSYRSPTGHYFCKKKRGLIPETLNELVQRRIEVKKGLKNEKNPERRRFLDVKQQALKLLANSMVGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 319 - protein, 773 aa, Artificial Sequence
  Description of Artificial Sequence: Synthetic polypeptide
MKKTLLDADYITRKEKAVVRLFYKTEEGREIQEVADFRPYMYVLPEERDLKKLQREIKELKNITNVEIKRMIEGNREVEVLKVMVNQPRDVPNLRGLIKELEGVREVREAHIPFVERYLIDSGLIPMQNVENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVVRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAIEKSILVPNRPSDRVVSERQRKTYIGAYVVEPKRGIHDNILLFDFRSFAGSIIISHNIDPSTIDCECCPEDSYRSPTGHYFCKKKRGLIPETLNELVQRRIEVKKGLKNEKNPERRRFLDVKQQSLKLLANSIYGYFGFPRARWYCLECAESITALGRKYHLHTIDIVPKFGFDVIYGDTDSVYLIKPNITDRERVMKDAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGDIVTYVVTKKGKSISDKARVIDFVEEGDYDPDYYINNQVLPSVLRILEALGYSEDELKGLGKQMKLGGF

SEQ ID NO: 320 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSSAGSIIISHNIDPSTIDCECCPEDSYRSPTGHYFCKKKRGLIPETLNELVQRRIEVKKGLKNEKNPERRRFLDVKQRALKLLANSMYGYFGFPRARWYCRECAESITALGRKYHLHTIDIVPKFGFDVIYGDTDSVYLIKPNITDRERVMKNAEHFLDKINSELPEAMELEFEGFYPRGIFITKKRYALIDEKGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 321 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSSAGSIIISHNIDPSTIDCECCPEDSYRSPTGHYFCKKKRGLIPETLNELVQRRIEVKKGLKNEKNPERRRFLDVKQRALKLLANSMYGYFGFPRARWYCLECAESITALGRKYHLHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 322 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSSAGSIIISHNIDPSTIDCECCPEDSYRSPTGHYFCKKKRGLIPETLNELVQRRIEVKKGLKNEKNPERRRFLDVKQQSLKLLANSMYGYFGFPRARWYCLECAESITALGRKYHLHTIDIVPKFGFDVIYGDTDSVYLIKPNITDRERVMKDAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSRDELKGLGKQMKLGGF

SEQ ID NO: 323 - protein, 766 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSFAGSIIISHNIDPSTIDCECCPEDSYRSPTGHYFCKKKRGLIPETLNELVQRRIEVKKGLKNEKNPERRRFLDVKQQSLKLLANSMYGYFGFPRARWYCLECAESITALGRKYHLHTIDIVPKFGFDVIYGDTDSVYLIKPNITDRERVMKDAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGK

SEQ ID NO: 324 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSSAGSIIISHNIDPSTIDCECCPEDSYRSPTGHYFCKKKRGLIPETLNELVQRRIEVKKGLKNEKNPERRRFLDVKQQALKLLANSMYGYFGFPRARWYCLECAESITALGRKYHLHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTIITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 325 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSLYPSIIISHNIDPSTIDCECCPEDSYRSPTGHYFCKKKRGLIPETLNELVQRKIEVKKGLKNEKNPERRRFLDVKQQALKLLANSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 326 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSSAGSIIISHNIDPSTIDCECCPEDSYRSPTGHYFCKKKRGLIPETLNELVQRRIEVKKGLKNEKNPERRRFLDIKQQALKALANSMYGYFGFPRARWYCRECAESITALGRKYHLHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 327 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSSAGSIIISHNIDPSTIDCECCPEDSYRSPTGHYFCKKKRGLIPETLNELVQRRIEVKKGLKNEKNPERRRFLDVKQRSLKALANSMYGYFGFPRARWYCRECAESITALGRKYHLHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 328 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSSAGSIIISHNIDPSTIDCECCPEDSYRSPTGHYFCKKKRGLIPETLNELVQRRIEVKKGLKNEKNPERRRFLDIKQQALKLLANSMYGYFGFPRARWYCLECAESITALGRKYHLHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 329 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSAASSIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 330 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSFAGSIIISHNIDPSTIDCECCPEDSYRSPTGHYFCKKKRGLIPETLNELMQRRIEVKKGLKNEKNPERRRFLDVKQQSLKLLANSMYGYFGFPRARWYCLECAESITALGRKYHLHTIDIVPKFGFDVIYGDTDSVYLIKPNITDRERVMKDAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 331 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSSGASIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 332 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFDMEVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSLYPSIIISHNIDPSTIDCECCPEDSYRSPTGHYFCKKKRGLIPETLNELVQRRIEVKKGLKNEKNPERRRFLDVKQQVLQLLAASMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 333 - protein, 773 aa, Artificial Sequence
  Description of Artificial Sequence: Synthetic polypeptide
MKKTLLDADYITRKEKAVVRLFYKTEEGREIQEVADFRPYMYVLPEERDLKKLQREIKELKNITNVEIKRMIEGNREVEVLKVMVNQPRDVPNLRGLIKELEGVKEVREAHIPFVERYLIDSGLIPMQNVENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVVRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAIEKSILVPNRPSDRVVSERQRKTYIGAYVVEPKRGIHDNILLFDFRSFAGSIIISHNIDPSTIDCECCPEDSYRSPTGHYFCKKKRGLIPETLNELVQRRIEVKKGLKNEKNPERRRFLDVKQQSLKLLANSIYGYFGFPRARWYCLECAESITALGRKYHLHTIDIVPKFGFDVIYGDTDSVYLIKPNITDRERVMKDAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGDIVTYVVTKKGKSISDKARVIDFVEEGDYDPDYYINNQVLPSVLRILEALGYSEDELKGLGKQMKLGGF

SEQ ID NO: 334 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRVLYPSIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 335 - protein, 773 aa, Artificial Sequence; identical to SEQ ID NO: 15
  Description of Artificial Sequence: Synthetic polypeptide

SEQ ID NO: 336 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSSAGSIIISHNIDPSTIDCECCPEDSYRSPTGHYFCKKKRGLIPETLNELVQRRIEVKKGLKNEKNPERRRFLDVKQQSLKLLANSMYGYFGFPRARWYCWECAESITALGRKYHLHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 337 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSSGVSIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYHLHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 338 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSSGVSIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 339 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRGGYPSIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 340 - protein, 773 aa, Artificial Sequence
  Description of Artificial Sequence: Synthetic polypeptide
MKKTLLDADYITREEKAVVRLFYKTEEGREIQEVADFRPYMYVLPEEHDPKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSFAGSIIISHNIDPSTIDCECCPEDSYRSPTGHYFCKKKRGLIPETLNELVQRRIEVKKGLKNEKNPERRRFLDVKQQSLKLLANSMYGYFGFPRARWYCLECAESITALGRKYHLHTIDIVPKFGFDVIYGDTDSVYLIKPNITDRERVMKDAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 341 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSLGASIIISHNIDPSTIDCECCPEDSYRSPTGHYFCKKKRGLIPETLNELVQRRIEVKKGLKNEKNPERRRFLDVKQQALKLLANSMGGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 342 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSFAGSIIISHNIDPSTIDCECCPEDSYRSPTGHYFCKKKRGLIPETLNELVQRRIEVKKGLKNEKNPERRRFLDVKQQSLKLLANSIYGYFGFPRARWYCLECAESITALGRKYHLHTIDIVPKFGFDVIYGDTDSVYLIKPNITDRERVMKDAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQIARGMAEYITEGPHIVAAKKAMKRGLEFKQGDIVTYVVTKKGKSISDKARVIDFVEEGDYDPDYYINNQVLPSVLRILEALGYSEDELKGLGKQMKLGGF

SEQ ID NO: 343 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIKGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSFAGSIIISHNIDPSTIDCECCPEDSYRSPTGHYFCKKKRGLIPETLNELVQRRIEVKKGLKNEKNPERRRFLDVKQQSLKLLANSMYGYFGFPRARWYCLECAESITALGRKYHLHTIDIVPKFGFDVIYGDTDSVYLIKPNITDRERVMKDAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 344 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSSGGSIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 345 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSISGSIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYHLHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 346 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSAGASIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYHLHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 347 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEIREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSFAGSIIISHNIDPSTIDCECCPEDSYRSPTGHYFCKKKRGLIPETLNELVQRRIEVKKGLKNEKNPERRRFLDVKQQSLKLLANSMYGYFGFPRARWYCLECAESITALGRKYHLHTIDIVPKFGFDVIYGDTDSVYLIKPNITDRERVMKDAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 348 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSAAASIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYLLHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 349 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFDKSILVPNRPSDRVVNERQRKTYIGAYVVEPKRGIHDNILLFDFRSSAGSIIISHNIDPSTIDCECCPEDSYRSPTGHYFCKKKRGLIPETLNELVQRRIEVKKGLKNEKNPERRRFLDVKQQSLKLLANSMYGYFGFPRARWYCRECAESITALGRKYHLHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 350 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSSAGSIIISHNIDPSTIDCECCPEDSYRSPTGHYFCKKKRGLIPETLNELVQRRIEVKKGLKNEKNPERRRFLDVKQQALKALANSMYGYFGFPRARWYCRECAESITALGRKYHLHTIDIVPKFGFDVIYGDTDSVYLIKPNITDRERVMKNAEHFLDKINSELPEAMELEFEGFYPRGIFITKKRYALIDEKGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 351 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLHRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSFAGSIIISHNIDPSTIDCECCPEDSYRSPTGHYFCKKKRGLIPETLNELVQRRIEVKKGLKNEKNPERRRFLDVKQQSLKLLANSMYGYFGFPRARWYCLECAESITALGRKYHLHTIDIVPKFGFDVIYGDTDSVYLIKPNITDRERVMKDAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 352 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSSAGSIIISHNIDPSTIDCECCPEDSYRSPTGHYFCKKKRGLIPETLNELVQRRIEVKKGLKNEKNPERRRFLDVKQQSLKLLANSMYGYFGFPRARWYCRECAESITALGRKYHLHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKGISDKARVIDFVEEGDYDPDYYINNQVLPSVLRILEALGYSEDELKGLGKQMKLGGF

SEQ ID NO: 353 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSVAASIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYHLHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 354 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSAAGSIIISHNIDPSTIDCECCPEDSYRSPTGHYFCKKKRGLIPETLNELVQRRIEVKKGLKNEKNPERRRFLDVKQQSLKLLANSMYGYFGFPRARWYCLECAESITALGRKYHLHTIDIVPKFGFDVIYGDTDSVYLIKPNITDRERVMKDAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 355 - protein, 773 aa, Artificial Sequence
  Description of Artificial Sequence: Synthetic polypeptide
MKKTLLDADFITRKEKAVVRLFYKTEEGREIQEVADFRPYMYVLPEERDLKKLQREIKELKNITNVEIKRMIEGNREVEVLKVMVNQPRDVPNLRGLIKELEGVKEVREAHIPFVERYLIDSGLIPMQDVENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSFGPSIIISHNIDPSTIDCECCPEDSYRSPTGHYFCKKKRGLIPETLNELVQRRIEVKKGLKNEKNPERRRFLDVKQQALKLLANSMYGYFGFPRARWYCLECAESISALGRKYHLHTIDIVPKFGFDVIYGDTDSVYLIKPNITDRERVMKDAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMADYKTEGPHIVAAKKAMKRGLEFKQGDIVTYVVTKKGKSISDKARVIDFVEEGDYDPDYYINNQVLPSVLRILEALGYSEDELKGLGKQMKLGGF

SEQ ID NO: 356 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSLYPSIIISHNIDPSTIDCECCPEDSYRSPTGHYFCKKKRGLIPETLNELVQRSIEVKKGLKNEKNPERRRFLDVKQQALKLLANSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 357 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSFAGSIIISHNIDPSTIDCECCPEDSYRSPTGHYFCKKKRGLIPETLNELVQRRIEVKKGLKNEKNPERRRFLDVKQQSLKLLANSMYGYFGFPRARWYCLECAESITALGRKYHLHTIDIVPRFGFDVIYGDTDSVYLIKPNITDRERVMKDAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 358 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSLYPSIIISHNIDPSTIDCECCPEDSYRSPTGHYFCKKKRGLIPETLNELVQRRIEVKKGLKNEKNPERRRFLDVKQQVLSLLAASMTGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 359 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSLYPSIIISHNIDPSTIDCECCPEDSYRSPTGHYFCKKKRGLIPETLNELVQRRIEVKKGLKNEKNPERRRFLDVKQQVLQLLAVSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 360 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSTAGSIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYHLHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 361 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSASPSIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 362 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSVAGSIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYHLHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 363 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSSAGSIIISHNIDPSTIDCECCPESSYRSPTGHYFCKKKRGLIPETLNELVQRRIEVKKGLKNEKNPERRRFLDVKQQSLKSLANSMYGYFGFPRARWYCRECAESITALGRKYHLHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 364 - protein, 773 aa, Artificial Sequence
  Description of Artificial Sequence: Synthetic polypeptide
MKKTLLDADYITRKEKAVVRLFYKTEEGREIQEVADFRPYMYVLPEERDLKKLQREIKELKNITNVEIKRMIEGNREVEVLKVMVNQPRDVPNLRGLIKELEGCKEVREAHIPFVERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSFAGSIIISHNIDPSTIDCECCPEDSYRSPTGHYFCKKKRGLIPETLNELVQRRIEVKKGLKNEKNPERRRFLDVKQQSLKLLANSIYGYFGFPRARWYCLECAESITALGRKYHLHTIDIVPKFGFDVIYGDTDSVYLIKPNITDRERVMKDAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 365 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSVAGSIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 366 - protein, 773 aa, Artificial Sequence; identical to SEQ ID NO: 85
  Description of Artificial Sequence: Synthetic polypeptide

SEQ ID NO: 367 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSLYPSIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYALHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 368 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSISGSIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 369 - protein, 773 aa, Artificial Sequence; identical to SEQ ID NO: 124
  Description of Artificial Sequence: Synthetic polypeptide

SEQ ID NO: 370 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSASGSIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 371 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSSAGSIIISHNIDPSTIDCECCPEDSYRSPTGHYFCKKKRGLIPETLNELVQRRIEVKKGLKNEKNPERRRFLDVKQGSLKALANSMYGYFGFPRARWYCRECAESITALGRKYHLHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 372 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSIGASIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 373 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSAITSIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 374 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSSAPSIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 375 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSTAASIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYHLHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 376 - protein, 775 aa, Artificial Sequence
  Description of Artificial Sequence: Synthetic polypeptide
MILDTDYITENGKPVIRVFKKENGEFKIEYDRTFEPYFYALLKDDSAIEDVKKVTAKRHGTVVKVKRAEKVQKKFLGRPIEVWKLYFNHPQDVPAIRDRIRAHPAVVDIYEYDIPFAKRYLIDKGLIPAEGDEELTMLAFAIATLYHEGEEFGTGPILMISYADGSEARVITWKKIDLPYVDVVSTEKEMIKRFLRVVREKDPDVLITYNGDNFDFAYLKKRCEELGIKFTLGRDGSEPKIQRMGDRFAVEVKGRIHFDLYPVIRRTINLPTYTLEAVYEAVFGKPKEKVYAEEIAQAWESGEGLERVARYSMEDAKVTYELGREFFPMEAQLSRLIGQSLWDVSRSSTGNLVEWFLLRKAYKRNELAPNKPDERELARRRGGYAGGYVKEPERGLWDNIVYLDFRSSAGSIIITHNVSPDTLNREGCKEYDVAPEVGHKFCKDFPGFIPSLLGDLLEERQKIKRKMKATVDPLEKKLLDYRQRSIKILANSFYGYYGYAKARWYCLECAESVTAWGREYHEMVIRELEEKFGFKVLYADTDGLHATIPGADAETVKKDAKEFLKYINPKLPGLLELEYEGFYVRGFFVTKKKYAVIDEEGKITTRGLEIVRRDWSEIAKETQARVLEAILKHGDVEEAVRIVKEVTEKLSKYEVPPEKLVIHEQITRDLRDYKATGPHVAVAKRLAARGVKIRPGTVISYIVLKGSGRIGDRAIPADEFDPTKHRYDAEYYIENQVLPAVERILKAFGYRKEDLRYQKTKQVGLGAWLKVKGKK

SEQ ID NO: 377 - protein, 775 aa, Artificial Sequence
  Description of Artificial Sequence: Synthetic polypeptide
MILDTDYITENGKPVIRVFKKENGEFKIEYDRTFEPYFYALLKDDSAIEDVKKVTAKRHGTVVKVKRAEKVQKKFLGRPIEVWKLYFNHPQDVPAIRDRIRAHPAVVDIYEYDIPFAKRYLIDKGLIPAEGDEELTMLAFAIATLYHEGEEFGTGPILMISYADGSEARVITWKKIDLPYVDVVSTEKEMIKRFLRVVREKDPDVLITYNGDNFDFAYLKKRCEELGIKFTLGRDGSEPKIQRMGDRFAVEVKGRIHFDLYPVIRRTINLPTYTLEAVYEAVFGKPKEKVYAEEIAQAWESGEGLERVARYSMEDAKVTYELGREFFPMEAQLSRLIGQSLWDVSRSSTGNLVEWFLLRKAYKRNELAPNKPDERELARRRGGYAGGYVKEPERGLWDNIVYLDFRSFAGSIIITHNVSPDTLNREGCKEYDVAPEVGHKFCKDFPGFIPSLLGDLLEERQKIKRKMKATVDPLEKKLLDYRQRSIKILANSFYGYYGYAKARWYCLECAESVTAWGREYHEMVIRELEEKFGFKVLYADTDGLHATIPGADAETVKKDAKEFLKYINPKLPGLLELEYEGFYVRGFFVTKKKYAVIDEEGKITTRGLEIVRRDWSEIAKETQARVLEAILKHGDVEEAVRIVKEVTEKLSKYEVPPEKLVIHEQITRDLRDYKATGPHVAVAKRLAARGVKIRPGTVISYIVLKGSGRIGDRAIPADEFDPTKHRYDAEYYIENQVLPAVERILKAFGYRKEDLRYQKTKQVGLGAWLKVKGKK

SEQ ID NO: 378 - protein, 775 aa, Artificial Sequence
  Description of Artificial Sequence: Synthetic polypeptide
MILDTDYITENGKPVIRVFKKENGEFKIEYDRTFEPYFYALLKDDSAIEDVKKVTAKRHGTVVKVKRAEKVQKKFLGRPIEVWKLYFNHPQDVPAIRDRIRAHPAVVDIYEYDIPFAKRYLIDKGLIPAEGDEELTMLAFAIATLYHEGEEFGTGPILMISYADGSEARVITWKKIDLPYVDVVSTEKEMIKRFLRVVREKDPDVLITYNGDNFDFAYLKKRCEELGIKFTLGRDGSEPKIQRMGDRFAVEVKGRIHFDLYPVIRRTINLPTYTLEAVYEAVFGKPKEKVYAEEIAQAWESGEGLERVARYSMEDAKVTYELGREFFPMEAQLSRLIGQSLWDVSRSSTGNLVEWFLLRKAYKRNELAPNKPDERELARRRGGYAGGYVKEPERGLWDNIVYLDFRSFAGSIIITHNVSPDTLNREGCKEYDVAPEVGHKFCKDFPGFIPSLLGDLLEERQKIKRKMKATVDPLEKKLLDYRQRSIKILANGFYGYYGYAKARWYCLECAESVTAWGREYHEMVIRELEEKFGFKVLYADTDGLHATIPGADAETVKKDAKEFLKYINPKLPGLLELEYEGFYVRGFFVTKKKYAVIDEEGKITTRGLEIVRRDWSEIAKETQARVLEAILKHGDVEEAVRIVKEVTEKLSKYEVPPEKLVIHEQITRDLRDYKATGPHVAVAKRLAARGVKIRPGTVISYIVLKGSGRIGDRAIPADEFDPTKHRYDAEYYIENQVLPAVERILKAFGYRKEDLRYQKTKQVGLGAWLKVKGKK

SEQ ID NO: 379 - protein, 775 aa, Artificial Sequence
  Description of Artificial Sequence: Synthetic polypeptide
MILDTDYITENGKPVIRVFKKENGEFKIEYDRTFEPYFYALLKDDSAIEDVKKVTAKRHGTVVKVKRAEKVQKKFLGRPIEVWKLYFNHPQDVPAIRDRIRAHPAVVDIYEYDIPFAKRYLIDKGLIPMEGDEELTMLAFAIATLYHEGEEFGTGPILMISYADGSEARVITWKKIDLPYVDVVSTEKEMIKRFLRVVREKDPDVLITYNGDNFDFAYLKKRCEELGIKFTLGRDGSEPKIQRMGDRFAVEVKGRIHFDLYPVIRRTINLPTYTLEAVYEAVFGKPKEKVYAEEIAQAWESGEGLERVARYSMEDAKVTYELGREFFPMEAQLSRLIGQSLWDVSRSSTGNLVEWFLLRKAYKRNELAPNKPDERELARRRGGYAGGYVKEPERGLWDNIVYLDFRSSAGSIIITHNVSPDTLNREGCKEYDVAPEVGHKFCKDFPGFIPSLLGDLLEERQKIKRKMKATVDPLEKKLLDYRQRSIKILANSFYGYYGYAKARWYCLECAESVTAWGREYHEMVIRELEEKFGFKVLYADTDGLHATIPGADAETVKKDAKEFLKYINPKLPGLLELEYEGFYVRGFFVTKKKYAVIDEEGKITTRGLEIVRRDWSEIAKETQARVLEAILKHGDVEEAVRIVKEVTEKLSKYEVPPEKLVIHEQITRDLRDYKATGPHVAVAKRLAARGVKIRPGTVISYIVLKGSGRIGDRAIPADEFDPTKHRYDAEYYIENQVLPAVERILKAFGYRKEDLRYQKTKQVGLGAWLKVKGKK

SEQ ID NO: 380 - protein, 775 aa, Artificial Sequence
  Description of Artificial Sequence: Synthetic polypeptide
MILDTDYITENGKPVIRVFKKENGEFKIEYDRTFEPYFYALLKDDSAIEDVKKVTAKRHGTVVKVKRAEKVQKKFLGRPIEVWKLYFNHPQDVPAIRDRIRAHPAVVDIYEYDIPFAKRYLIDKGLIPMEGDEELTMLAFAIATLYHEGEEFGTGPILMISYADGSEARVITWKKIDLPYVDVVSTEKEMIKRFLRVVREKDPDVLITYNGDNFDFAYLKKRCEELGIKFTLGRDGSEPKIQRMGDRFAVEVKGRIHFDLYPVIRRTINLPTYTLEAVYEAVFGKPKEKVYAEEIAQAWESGEGLERVARYSMEDAKVTYELGREFFPMEAQLSRLIGQSLWDVSRSSTGNLVEWFLLRKAYKRNELAPNKPDERELARRRGGYAGGYVKEPERGLWDNIVYLDFRSFAGSIIITHNVSPDTLNREGCKEYDVAPEVGHKFCKDFPGFIPSLLGDLLEERQKIKRKMKATVDPLEKKLLDYRQRSIKILANSFYGYYGYAKARWYCLECAESVTAWGREYHEMVIRELEEKFGFKVLYADTDGLHATIPGADAETVKKDAKEFLKYINPKLPGLLELEYEGFYVRGFFVTKKKYAVIDEEGKITTRGLEIVRRDWSEIAKETQARVLEAILKHGDVEEAVRIVKEVTEKLSKYEVPPEKLVIHEQITRDLRDYKATGPHVAVAKRLAARGVKIRPGTVISYIVLKGSGRIGDRAIPADEFDPTKHRYDAEYYIENQVLPAVERILKAFGYRKEDLRYQKTKQVGLGAWLKVKGKK

SEQ ID NO: 381 - protein, 775 aa, Artificial Sequence
  Description of Artificial Sequence: Synthetic polypeptide
MILDTDYITENGKPVIRVFKKENGEFKIEYDRTFEPYFYALLKDDSAIEDVKKVTAKRHGTVVKVKRAEKVQKKFLGRPIEVWKLYFNHPQDVPAIRDRIRAHPAVVDIYEYDIPFAKRYLIDKGLIPMEGDEELTMLAFAIATLYHEGEEFGTGPILMISYADGSEARVITWKKIDLPYVDVVSTEKEMIKRFLRVVREKDPDVLITYNGDNFDFAYLKKRCEELGIKFTLGRDGSEPKIQRMGDRFAVEVKGRIHFDLYPVIRRTINLPTYTLEAVYEAVFGKPKEKVYAEEIAQAWESGEGLERVARYSMEDAKVTYELGREFFPMEAQLSRLIGQSLWDVSRSSTGNLVEWFLLRKAYKRNELAPNKPDERELARRRGGYAGGYVKEPERGLWDNIVYLDFRSFAGSIIITHNVSPDTLNREGCKEYDVAPEVGHKFCKDFPGFIPSLLGDLLEERQKIKRKMKATVDPLEKKLLDYRQRSIKILANGFYGYYGYAKARWYCLECAESVTAWGREYHEMVIRELEEKFGFKVLYADTDGLHATIPGADAETVKKDAKEFLKYINPKLPGLLELEYEGFYVRGFFVTKKKYAVIDEEGKITTRGLEIVRRDWSEIAKETQARVLEAILKHGDVEEAVRIVKEVTEKLSKYEVPPEKLVIHEQITRDLRDYKATGPHVAVAKRLAARGVKIRPGTVISYIVLKGSGRIGDRAIPADEFDPTKHRYDAEYYIENQVLPAVERILKAFGYRKEDLRYQKTKQVGLGAWLKVKGKK

SEQ ID NO: 382 - protein, 775 aa, Artificial Sequence; identical to SEQ ID NO: 376
  Description of Artificial Sequence: Synthetic polypeptide

SEQ ID NO: 383 - protein, 775 aa, Artificial Sequence; identical to SEQ ID NO: 377
  Description of Artificial Sequence: Synthetic polypeptide

SEQ ID NO: 384 - protein, 775 aa, Artificial Sequence; identical to SEQ ID NO: 378
  Description of Artificial Sequence: Synthetic polypeptide

SEQ ID NO: 385 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSLVVSIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 386 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSSAGSIIISHNIDPSTIDCECCPEDSYRSPTGHYFCKKKRGLIPETLNELVQRRIEVKAGLKNEKNPERRRFLDVKQQALKLLANSMYGYFGFPRARWYCLECAESITALGRKYHLHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 387 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSLAVSIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 388 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSGGGSIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 389 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSLYPSIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYVLHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 390 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSSAGSIIISHNIDPSTIDCECCPEDSYRSPTGHYFCKKKRGLIPETLNELVQRRIEVKKGLKNEKNPERRRFLDIKQQSLKALANSMYGYFGFPRARWYCRECAESITALGRKYHLHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 391 - protein, 778 aa, Unknown
  Description of Unknown: Candidatus Altiarchaeales archaeon sequence
MKKTLLDADYITREEKAVVRLFYKTEEGREIQEVADFRPYMYVLPEEHDLKKLQREIKELKNVTNVEIKRMIEGDREVEVLKVMVNQPRDVPNLRGLIKELEGCKEVREAHIPFAERYLIDSGLIPMQDCENFDLRIAAFDMEVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGAKVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKNILVPNRPSDRVVNERQRKTYIGAYVVEPKRGIHDNILLFDFRSLYPSIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGSQGSYT

SEQ ID NO: 392 - protein, 773 aa, Artificial Sequence; identical to SEQ ID NO: 297
  Description of Artificial Sequence: Synthetic polypeptide

SEQ ID NO: 393 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSLYPSIIISHNIDPSTIDCECCPEDSYRSPTGHYFCKKKRGLIPETLNELVQRRIEVKKGLKNEKNPERRRFLDVKQQALKLLANSMYGYFGFPRARWYCRECAESITALGRKYILHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 394 - protein, 773 aa, Artificial Sequence
  Description of Artificial Sequence: Synthetic polypeptide
MKKTLLDADYITRKEKAVVRLFYKTEEGREIQEVADFRPYMYVLPEERDLKKLQREIKELKNITNVEIKRMIEGNREVEVLKVMVNQPRDVPNLRGLIKELEGCKEVREAHIPFVERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSFAGSIIISHNIDPSTIDCECCPEDSYRSPTGHYFCKKKRGLIPETLNELVQRRIEVKKGLKNEKNPERRRFLDVKQQSLKLLANSIYGYFGFPRARWYCLECAESITALGRKYHLHTIDIVPKFGFDVIYGDTDSVYLIKPNITDRERVMKDAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGDIVTYVVTKKGKSISDKARVIDFVEEGDYDPDYYINNQVLPSVLRILEALGYSEDELKGLGKQMKLGGF

SEQ ID NO: 395 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSSAGSIIISHNIDPSTIDCECCPEDSYRSPTGHYFCKKKRGLIPETLNELVQRRIEVKKGLKNEKNPERRRFLDVKQQALKALANSMYGYFGFPRARWYCLECAESITALGRKYHLHTIDIVPKFGFDVIYGDTDSVYLIKPNITDRERVMKNAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 396 - protein, 773 aa, Artificial Sequence
  Description of Artificial Sequence: Synthetic polypeptide
MKKTLLDADYITRGEKAVVRLFYKTEEGREIQEVADSRPYMYVLPEEHDLKKLQREIKELKNITNVEIKRMIEGDREVEVLKVMVNQPRDVPNLRGLIKELEGCKEVREAHIPFAERYLIDSGQIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSFAGSIIISHNIDPSTIDCECCPEDSYRSPTGHYFCKKKRGLIPETLNELVQRRIEVKKGLKNEKNPERRRFLDVKQQSLKLLANSMYGYFGFPRARWYCLECAESITALGRKYHLHTIDIVPKFGFDVIYGDTDSVYLIKPNITDRERVMKDAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 397 - protein, 773 aa, Artificial Sequence
  Description of Artificial Sequence: Synthetic polypeptide
MKKTLLDADYITREEKAVVRLFYKTEEGREIQEVADFRPYMYVLPEEHDLKKLQREIKELKNITNVEIKRMIEGDREVEVLKVMVNQPRDVPNLRGLIKELEGCKEVREAHIPFAERYLIDSGLIPMQDCENFDLRIAAFAMAVYNPRGEPKAERDPIIIISYADNRGLRRVWTYKTVENLNLDYMEVLKDEREIIRRFIDTIREREIDIIVTYNGDNFDFPYLKERAEKHRIPVSLGVDGSPLRLERRGMNLGARVTGRPHIDMYPVCRQIFNLSRYTLEDVYLEITGREKKDIRVGEMAGIWDNPEKEKFKELIEYAMSDAESTLEIAITLLPLHYEISRITRELIYQSSRAGSGQRVESLLIKKAFEKSILVPNRPSDRVVNERQRKTYIGAYVVEPKRGIHDNILLFDFRSFAGSIIISHNIDPSTIDCECCPEDSYRSPTGHYFCKKKRGLIPETLNELVQRRIEVKKGLKNEKNPERRRFLDVKQQSLKLLANSMYGYFGFPRARWYCLECAESITALGRKYHLHTIDIVPKFGFDVIYGDTDSVYLIKPNITERERVMKDAEHFLDKINSELPEAMELEFEGFYPRGIFITKKRYALIDERGKLIVKGLETKRRDWANIAKDTQEKVLDALLKDKNPEKAASIVKDVIRNIKTGKIPLKDLAINTQITRGMAEYKTEGPHIVAAKKAMKRGLEFKQGNIVTYVVTKKGKSISDKARVIDFVEEGDYDPDYYINNQVLPSVLRILEALGYSEDELKGLGKQMKLGGF

SEQ ID NO: 398 - protein, 6 aa, Artificial Sequence
  Description of Artificial Sequence: Synthetic 6x his tag
HHHHHH

SEQ ID NO: 399 - protein, 5 aa, Unknown
  Description of Unknown: Candidatus Altiarchaeales archaeon sequence
QGSYT

The invention claimed is:

1. A method for performing nucleic acid sequencing, comprising:

(a) contacting an engineered polymerase with (i) a nucleic acid template molecule and (ii) a nucleic acid primer,
 wherein said contacting is conducted under a condition suitable for the engineered polymerase to bind to the nucleic acid template molecule and the nucleic acid primer, thereby forming a complexed polymerase, wherein the complexed polymerase comprises an engineered polymerase bound to a nucleic acid duplex,
 wherein the nucleic acid duplex comprises the nucleic acid template molecule hybridized to the nucleic acid primer,
 wherein the engineered polymerase comprises an amino acid sequence having at least 90% sequence identity to the amino acid sequence of SEQ ID NO:1 and has amino acid substitutions Asp141Ala and Glu143Ala;

(b) contacting the complexed polymerase with a multivalent polymer-nucleotide conjugate to form a multivalent-binding complex,
 wherein the multivalent polymer-nucleotide conjugate comprises a core attached to multiple nucleotide arms,
 wherein at least one of the nucleotide arms is attached to a nucleotide unit,
 wherein said contacting is conducted under a condition suitable for
 binding the nucleotide unit of at least one of the nucleotide arms of the multivalent polymer-nucleotide conjugate to a corresponding complementary nucleotide base of the nucleic acid template molecule, and
 inhibiting polymerase-catalyzed extension of the nucleic acid duplex;

(c) detecting the multivalent-binding complex; and (d) determining the sequence of the nucleic acid template molecule.

2. The method of claim 1, further comprising:

(e) dissociating the multivalent-binding complex, wherein said dissociating comprises:
 dissociating the engineered polymerase and its bound multivalent polymer-nucleotide conjugate from the nucleic acid duplex while retaining the nucleic acid duplex;

(f) contacting the retained nucleic acid duplex with a second engineered polymerase under a condition suitable for the second engineered polymerase to bind to the retained nucleic acid duplex, thereby forming a second complexed polymerase,
 wherein the second complexed polymerase comprises a second engineered polymerase bound to the retained nucleic acid duplex,
 wherein the second engineered polymerase comprises an amino acid sequence having at least 90% sequence identity to the amino acid sequence of SEQ ID NO: 1 and has amino acid substitutions Asp141Ala and Glu143Ala; and (g) contacting the second complexed polymerase with a free nucleotide or free nucleotide derivative, thereby forming a nucleotide-binding complex,
 wherein said contacting is conducted under a condition suitable for polymerase-catalyzed extension of the nucleic acid duplex.

3. The method of claim 2, further comprising:

(h) detecting complementary nucleotides in the nucleotide-binding complex.

4. The method of claim 3, further comprising:

(i) identifying nucleotide bases of the complementary nucleotides in the nucleotide-binding complex.

5. The method of claim 1, wherein said contacting the complexed polymerase with the multivalent polymer-nucleotide conjugate of step (b) is conducted in the presence of a non-catalytic divalent cation that inhibits polymerase-catalyzed nucleotide incorporation, wherein the non-catalytic divalent cation comprises strontium or barium.

6. The method of claim 2, wherein said contacting the second complexed polymerase with the free nucleotide or free nucleotide derivative of step (g) is conducted in the presence of a catalytic divalent cation that promotes polymerase-catalyzed nucleotide incorporation, wherein the catalytic divalent cation comprises magnesium or manganese.

7. The method of claim 1, wherein the nucleic acid template molecule in step (a) comprises a clonally amplified template molecule.

8. The method of claim 1, wherein the nucleic acid template molecule of step (a) comprises a copy of a target sequence of interest or comprises a concatemer having two or more tandem copies of a target sequence of interest.

9. The method of claim 1, wherein the nucleic acid template molecule in step (a) comprises a single target sequence or multiple different target sequences.

10. The method of claim 1, wherein at least one of the nucleotide arms of the multivalent polymer-nucleotide conjugate comprises:

(i) a core attachment moiety, (ii) a spacer, and (iii) a linker, wherein the core of the multivalent polymer-nucleotide conjugate is attached to at least one of the nucleotide arms via the core attachment moiety, wherein the spacer is attached to the linker, and wherein the linker is attached to the nucleotide unit that is carried by the at least one of the nucleotide arms.

11. The method of claim 10, wherein the linker comprises an aliphatic chain having 2-6 subunits or an oligo ethylene glycol chain having 2-6 subunits.

12. The method of claim 10, wherein the plurality of nucleotide arms attached to the core of the multivalent polymer-nucleotide conjugate have the same type of nucleotide units, and wherein the nucleotide unit is selected from a group consisting of dATP, dGTP, dCTP, dTTP and dUTP.

13. The method of claim 10, wherein the multivalent polymer-nucleotide conjugate comprises one type of nucleotide unit selected from a group consisting of dATP, dGTP, dCTP, dTTP and dUTP.

14. The method of claim 1, wherein the multivalent polymer-nucleotide conjugate is labeled with a fluorophore.

15. The method of claim 1, wherein the contacting in steps (a) and (b) are conducted at an isothermal temperature of 25-75° C.

16. The method of claim 1, wherein the detecting of step (c) and identifying of step (d) are conducted at an isothermal temperature of 25-75° C.

17. The method of claim 2, wherein the free nucleotide or free nucleotide derivative in step (g) comprises an aromatic base, a five carbon sugar, and 1-10 phosphate groups.

18. The method of claim 17, wherein the free nucleotide or free nucleotide derivative of step (g) comprises the free nucleotide or free nucleotide derivative selected from a group consisting of dATP, dGTP, dCTP, dTTP and dUTP.

19. The method of claim 17, wherein the free nucleotide or free nucleotide derivative in step (g) is labeled with a fluorophore.

20. The method of claim 17, wherein the free nucleotide or free nucleotide derivative in step (g) lack a fluorophore label.

21. The method of claim 17, wherein the free nucleotide or free nucleotide derivative in step (g) comprises a removable chain terminating moiety attached to the 3' carbon position of the sugar group, wherein the removable chain terminating moiety comprises an alkyl group, alkenyl group, alkynyl group, allyl group, aryl group, benzyl group, azide group, azido group, O-azidomethyl group, amine group, amide group, keto group, isocyanate group, phosphate group, thio group, disulfide group, carbonate group, urea group, or silyl group, and wherein the removable chain terminating moiety is cleavable with a chemical compound to generate an extendible 3'OH moiety on the sugar group.

22. The method of claim 1, wherein the complexed polymerase in step (a) is immobilized to a support or immobilized to a coating on the support to form an immobilized complexed polymerase.

23. The method of claim 22, wherein the density of the complexed polymerase immobilized to the support is $10^2$-$10^9$ per $mm^2$.

24. The method of claim 22, wherein the polymerase is immobilized to a pre-determined site on the support, or immobilized to a random site on the support.

25. The method of claim 22, wherein the coating comprises at least one hydrophilic polymer coating layer which comprises branched polyethylene glycol (PEG) having at least 4 branches.

26. The method of claim 25, wherein the hydrophilic polymer coating has a water contact angle of no more than 45 degrees.

27. The method of claim 10, wherein the complexed engineered polymerase binds to a portion of the nucleic acid template molecule, and wherein the method further comprises binding a second nucleic acid primer, a second engineered polymerase, and the first multivalent polymer-nucleotide conjugate to a second portion of the nucleic acid template molecule thereby forming the second complexed engineered polymerase, wherein a second nucleotide unit of the first multivalent polymer-nucleotide conjugate binds to the second engineered polymerase, wherein the first and second complexed engineered polymerases which include the same multivalent polymer-nucleotide conjugate forms an avidity complex.

* * * * *